United States Patent 10,695,415 (LIVE ATTENUATED ORAL VACCINE AGAINST SHIGELLOSIS AND TYPHOID FEVER) - sequence listing, part 4

SEQ ID NO: 2 - DNA, 4795994 bp, Artificial Sequence (residues 1-1,598,665 of 4,795,994)
  Ty21a-ABC, clone #2-2
agagattacgtctggttgcaagagatcataacaggggaaattgattgaaaataaatatatcgccagcagcacatgaacaagtttcggaatgtgatcaatttaaaaatttattgacttaggcgggcagatactttaaccaatataggaatacaagacagacaaataaaaatgacagagtacacaacatccatgaaccgcatcagcaccaccaccattaccaccatcaccattaccacaggtaacggtgcgggctgacgcgtacaggaaacacagaaaaaagcccgcacctgaacagtgcgggcttttttttcgaccagagatcacgaggtaacaaccatgcgagtgttgaagttcggcggtacatcagtggcaaatgcagaacgttttctgcgtgttgccgatattctggaaagcaattccaggcaagggcaggtagcgaccgtactttccgcccccgcgaaaattaccaaccatctggtggcgatgattgaaaaaactatcggcggccaggatgctttgccgaatatcagcgatgccgaacgtattttttctgacctgctcgcaggacttgccagcgcgcagccgggattcccgcttgcacggttgaaaatggttgtcgaacaagaattcgctcagatcaaacatgttttgcatggtatcagcctgctgggtcagtgcccggatagcatcaacgccgcgctgatttgccgtggcgaaaaaatgtcgatcgcgattatggcgggactcctggaggcgcgtggacatcgcgtcacggtgatcgatccggtagaaaaactgctggcggtgggccattaccttgaatctaccgtcgatatcgcggaatcgactcgccgtatcgccgccagccagatcccggccgatcacatgatcctgatggcgggctttactgccggtaatgaaaagggtgaactggtggtgctgggccgtaatggttccgactattccgccgccgtgctggccgcctgtttacgcgctgactgctgtgaaatctggactgacgtcgatggcgtgtatacctgtgacccgcgccaggtgccggacgccaggctgttgaaatcgatgtcctaccaggaagcgatggagctctcttacttcggcgctaaagtccttcaccctcgcaccataacgcctatcgcccagttccagatcccctgtctgattaaaaataccggcaatccgcaggcgccaggaacgctgatcggcgcgtccagcgacgatgataatctgccggttaaagggatctctaaccttaacaacatggcgatgtttagcgtctccggcccgggaatgaaagggatgattgggatggcggcgcgtgttttcgccgccatgtctcgcgccgggatctcggtggtgctcattacccagtcctcctctgagtacagcatcagcttctgtgtgccgcagagtgactgcgcgcgtgcccgccgtgcgatgcaggatgagttctatctggagctgaaagaggggctgctggagccgctggcggttacggagcggttggcgattatctctgttgtcggcgacggtatgcgcacgctacgcggcatttcagcgaaattcttcgccgcgctggcgcgggctaatatcaatatcgtggcgatcgctcagggatcttctgagcgttccatttctgtggtggtgaataacgacgatgccaccaccggcgtgcgggtaacgcaccagatgctgttcaataccgatcaggtgattgaagtgtttgtcattggcgtcggcggcgtcggcggcgcgctactggaacagcttaaacgtcagcaaacctggctgaagaacaagcacatcgatctacgcgtgtgcggcgtggcgaactcaaaggcgttgctaaccaatgtgcatggcctgaatctggacaactggcaggcggaactggcgcaagcgaacgcgccgttcaatctgggacgtttaattcgcctggtgaaagaatatcatctactcaatccggtgattgttgattgtacctccagtcaggcggtggccgaccagtatgccgacttcctgcgcgaagggttccatgtggtgacgccgaacaagaaagcgaacacctcgtcgatggactactaccatcagctacgtttcgccgccgcgcaatcacggcgcaaattcttgtatgacaccaacgtcggcgccggtttgccggtaatcgaaaacctgcaaaacctgctgaatgcgggtgatgaactgcaaaaattttccggcattctttccgggtcgctctcttttattttcggtaaactggaagaggggatgagtctctcacaggcgaccgctctggcgcgcgagatgggctataccgaacccgatccgcgcgacgatctttccggtatggatgtggcgcgtaaactgttgatcctcgcccgcgagacgggccgcgagctggagctttccgatatcgtgattgaaccggtgttgccggacgagtttgacgcctccggcgatgtgaccgcctttatggcgcatctgccgcagcttgacgacgcgtttgccgcccgtgtggcgaaagctcgtgatgaaggtaaggtattgcgctatgtgggcaatatcgaagaggatggcgtgtgccgcgtgaagattgccgaagttgatggtaacgatccgctcttcaaagtgaaaaacggtgaaaacgcgctggcgttctacagccattattatcagcccttgccgttggtgctgcgcggctacggcgcaggcaatgatgtgacggcggcgggcgtgtttgccgatctgttacggaccctctcatggaagttaggagtttaacatggtgaaagtgtatgccccggcttccagcgcgaacatgagcgtcggtttcgacgtgttgggcgcggccgtcacacccgttgacggcacgttgctgggcgatgtggtatccgttgaagcagcggatcatttccgtctgcataacctggggcgatttgccgataaactgccgccggagccgcgtgaaaatattgtttatcagtgctgggaacgtttttgccaggcattggggaaaaccatcccggtggcgatgacgctggaaaaaaatatgccgattggttccgggttagggtccagcgcctgttccgtcgtcgccgcgctggtcgcgatgaatgagcactgcggcaaaccgttaaacgacacgcgtctgttggcgctgatgggcgagctggaaggccgtatctccggcagcatccattacgataacgtcgcgccgtgctttcttggcggtatgcagttgatgattgaagaaaacggcattattagtcagcaggtgccgggctttgatgagtggctatgggtactggcttatccgggcattaaagtttccaccgcagaagcacgggccattttgcctgcgcagtatcgccgtcaggattgcattgcgcatggacggcatctggccggttttattcacgcctgttactcgcggcagccgcagcttgccgccgcgctgatgaaagatgttattgccgaaccataccgcgcgcgtttactgccgggctttagccaggcgcggcaggcggtgtcggagatcggcgcgctggcgagcgggatttccggatcggggccgacgctgtttgcgctatgcgataaaccggagacggcgcagcgcgtcgcggactggctgagcaaacattatctgcaaaatcaggaaggcttcgttcatatttgtcggctggatacggcgggcgcacgagtagtgggataatcaatgaaactctataatctgaaagaccataatgagcaggtcagctttgcgcaggccgtcacgcaagggctgggcaaacagcagggacttttttttccgcacgatctgccggagtttagcctgacggaaattgatgagatgctcaaccaggactttgtcagccgtagcgcaaagatcctctcggcatttattggcgatgaaataccgcagcaaattctggaagagcgcgtccgcgcggcgtttgctttcccggcgccggtagcgcaggtagaaagtgatgtcggctgcctggagctgttccatggtccgacgctggcctttaaagacttcggcgggcgttttatggcgcaaatgctgacgcatatcagcggcgataaaccggtgacgattctgaccgcaacgtcaggcgataccggcgcggcggtggctcacgcgttctatggcctggaaaatgtgcgggtcgtcattctctacccgcgcggtaaaatcagtccgttgcaggaaaaactgttctgtacgctgggcggcaacattgagaccgtggcgatcgacggcgatttcgacgcttgccaggcgctggtgaaacaggcatttgatgacgaagaactgaaaacggcgctggggttgaattcggctaattcgattaatatcagccgcctgctggcgcaaatttgctactactttgaagccgtggcgcaactgccgcagggggcgcgtaaccaactggtgatctccgtacccagcggcaactttggcgatttgacggcaggactgctggcgaagtcgttaggcctaccggtgaaacgctttatcgccgccaccaacattaacgatacggtgccgcgttttctgcatgacgggaagtgggcgccaaaagcgacgcaggcgaccctgtcgaatgcgatggatgtcagccagccgaataactggccgcgtgtggaggagctattccgccgtaaaatctggcgtctgactgagctgggctatgcggcggtggatgacactacgacacaacagacgatgcgcgagctgaaagcgaaaggttatatctcggaacctcatgcggcggtagcgtatcgggcattacgcgaccagttaaaccctggcgagtatggcttgtttctcggaacggcgcatccggcgaagtttaaagaaagcgtggagtccattctgggagaaacgctggcattgcctgaagcgctcgccgaacgcgccgatctgccgttgctttcacatcatctgcctgcggattttgccgccctgcgtaagctaatgatgacccgccagtaaccattgcgcccggtggcgctgtcgcttaccgggcctatggggtggtgccgatttgtaggccggataaggcgtaaccgccatccggcgatgtcgttactgctcgtagcgtttaaagaccagctcgtcttgtgtggaggtttcttcatcaaagaaatacccttcacggtcaaacgcggtaagctgttccggcttcgttaagcggttttcaataataaaacgactcatcagtccgcgcgcttttttggcgtagaagcttaccaccttaaacttgccgtttttctcatcaaggaatacgggcttaatcagttcggcatccagtttcttcggcttcaccgatttaaaatattcctcggaggccagattcaccaccacccgatcgccctgcgcctcaagcgcttcgttgagcttatcggtaatgatatcgccccagaattgataaagatctttgccgcgcggattctccaggcgaatccccatctccagacgataaggctgcattaaatccagcgggcgcaatacgccatacaagccagagagcatacgcagatgttgttgagcaaaatcaaaatccgcgtcgttgaacgtttccgcctgtaggccggtataaacatcgcctttgaacgccagaatcgcctggcgtgcattatccggcgtaaaatgaggctgccagtcatgaaaacgcgtggcgttgagatccgccagtttgtcgctaattcccattagcctggaaatttgcggcgccgaaagctggcgggcctgttgaataagctgctggctgtgatccaacagctccggctgggtatagcgggtcgtggccagcgggctttgataatcaagcgtttttgcaggtgaaatcagaatcagcatatccagtccttgcagggaattttctgcgactttagcaaaaaaacgccgcagagttgaccgatggttgcgattgtcggcttaatcgcgcgatgccgcatcccaggtatctggcgccagttgtggttcgatatccgggaagcgccgcggatcgaactgcggtcttacgcccagtttccgttgtcgcagataatcgccggcgagggtatacaccaccggtgagagcaacaaaatcgccgtcagattggtaatggccatacaggccatgatcatgtcagcgagctgccatatcagcggaaaactgataagcgtaccggcgatgaccatgccaagcgtcgcaagacgtaatagccagatggcctttgcgttatgtaaccgcagaaaaaagagattgttttcggcgtaaatatagttggcgacgatagaactgaacgcgaacagaatgacgataagcgcgacaaaactggcgccccattcaccggtcaacgaaaccattgcatgttggagaagctgaatgccttctgttgacgaatgggacgcgtgattccccgccagcaggataatcatcgcgctggcggtacagatgataatggtgtcgctgaatacgccaatcatttgcacaatcccctgcgcgacagggtgagggggatacgacgttgccgctgcggccgcattaggcgttgaccccattcccgcttcattagagaacatcccacgctgaaaaccgctggtaatagcctgggtgagcgtatatccggctgcgcctgccgcggcttcctgccagccaaatgcgcttttgactatcgaggcgataacgccaggcatttgctcaatatgccagaggcaaatgaatacgctgccagcgacccacaataacgcgatgaggggaatcagccattgcatcaggcgggcgacgccttttatgccgcggatgataattaacagggcacagaacgccaaagcaatgccggagataagcggcggaatgttgaaggcgaaatggagcgcgcgtgagacggcattcgcctgcacgctattaaaaatcaacccgtaggcgacgagcagaaagagggcgaaaaccacgcccatccagcgcattcccagcccgcgcgccatataccacgccgggccgccgcggaactggcctgtcgggtcacgttctttataaagctgggcaagcgaacactcggcgaaggaggtcgccataccaatgatggccgagacccacatccagaatactgcgccgggaccgcctgcggcgatagccagcgccacgccggccagattaccgctgccaatccgcgccgcgaggctggtacacagcgcctgaaatgacgtcaggccgcctggctgcgggctaaggctgcctttcagactgcggctaaattggcgaatataacgaaactgaatgaatccggtacgccaggtaaaccaacatcctgcgccgagcagcaggtaaatcattaccgagccccagagtatttcgttaataaaactgaaaaactcaggcattaacgtccctcttgttgatgccgacacgctttgatgatcctgtataagcgtgacccatgatgtagatgaccttgtcaggctaatattaacggtagtttaccataaatacggcggtatcctttaattgcgcatcaaccgtcggcagatacgcaaacagttcacaagggcagccaggtgcatgtaggcggttgcgctgtgagtgcgtcgtgttatcatcagggtagaccggttacatcccctaacaagctgtttaaagagaaactctatcatgacggacaaattgacctcccttcgtcagttcaccaccgtagtggctgataccggagatatcgcggcaatgaagctgtaccagccgcaggatgctacaactaacccttctctcattcttaacgcagcgcaaatcccggaatatcgtaagctgattgacgatgctgtcgcctgggcgaaacagcagagcagcgaccgcgcgcagcaggttgttgacgcgaccgataagctggcggtgaatattggcctggaaatcctgaagctggtgccggggcgtatttctaccgaagttgacgcgcgtctatcttatgacactgaagcgtctatcgccaaagcaaaacgtatcattaaactctacaatgatgcgggtatcagcaacgatcgtatcctgatcaagctggcgtccacctggcagggcattcgcgcagccgaacagctggaaaaagaaggcatcaactgtaacctgacgctgctgttctccttcgcgcaggcgcgtgcgtgcgccgaagcgggcgtctacctgatctcgccgttcgtaggtcgtattcttgactggtataaagccaataccgacaagaaagactatgcgccagctgaagatccgggcgtggtttccgtaacggaaatctacgagtactacaaacagcatggttacgaaaccgtcgttatgggcgcaagcttccgtaacgtaggcgaaattctggagctggcgggctgcgaccgtctgactatcgcgccggcattgctgaaagaactggcggaaagcgaaggggcgattgagcgtaagctctctttctccggcgaagtcaaagcgcgtccggaacgtattaccgaagccgagttcctgtggcagcatcaccaggaccctatggcggttgacaaactggcggatggtatccgtaagtttgcggtagaccaggaaaaactggaaaaaatgatcggcgatctgctgtaatcattaacgcgtggccctgatatgggtcacgctacctcttctgaaacctgtctgtccttcctttcgcagtgtatcattctgtttaacgagactgtttaaacggaataatcatgaatactttacgcattggcctggtttccatttctgaccgtgcttccagcggcgtttaccaggataaaggtatcccggcccttgaagagtggctggcatctgcccttaccaccccttttgagctgcaaacgcgactgatcccggatgaacaggcgatcatcgaacagaccttatgtgaactggttgatgagatgagctgtcatctggtgctgaccactggcggtaccggtccggcacgtcgcgacgtcacgccggacgcgacccttgccatcgccgaccgtgaaatgcctggttttggcgaacagatgcgccagatcagcctgcgctttgtgccgaccgccattctttcccgccaggtgggcgttatccgtaaacaggcgttaattcttaatctgcctggacagccaaaatcgatcaaagaaacgctggaaggcgtaaaagcggacgatggcagcgttagcgtgccgggcatttttgcgagcgtgccgtattgcatacagctgcttgacgggccgtatgtcgaaaccgcgccggaagtggttgccgctttccgtccaaagagcgccagacgtgagaatatgtcgtcctgaccgggagatactgatagtagggttattcctcccggtgcgggaggaataaaagagatttagtgcgcctcgccgattggcaaaatagtgcggccaaattgctcgtttagcacttcacccatcgccagataaatagcgctggcgccgcaaaccagaccaacccagcctgcgatatggatagttgcttcgttaccggtgatattgccgaccgccagcagagcgaacagtacggtcaggctcaggaaaacaaattgcagcgcgcgggcggctttcagcgtaccgaagaacataaacagcgtgaacacgccccacagacctaaataagcgccgagtagctgagcgtcaggcgcatccgtcaggcccattttcggcatcagcaggatagcgaccagcgtcagccagaacgaaccgtaagaagtaaaggccgttaaaccaaaggtattgccttttttatactccagcagaccggcaaaaatttgcgcgataccgccgtagaaaatccccatcgccagaataataccgtccagggcgaaaaaaccggcattgtgcaggttaagcagaatggtggtcatgccgaagcccatcaggcccagcggtgccggattagccaacttagtgttgcccataattcctcaaaatcatcataattgaatggtgaaatagtttcccagaataacgagttccgtattcggggcgcggcataataatcagggggaagaggactgtctatgatctaataagggggaaaagaaaatatttccccctgtgagggcattcacgcctgaacggctgccatcattcgtcgcaggcaggctatttgcaagaccgccggaatagtcacgcgatacgcgctgccgctcatcgctttgacgccgtttaatgccgcgccgaccgggccgccaagacctgcgccgcgcagcaatccgtggcccaggatgctcattgcggcatgggtacgtaaaatgcgggtaagctgggtggaaagcaggtgggagaccccttttgccagactgcgatctttcatgagcagcggcagcagttcttccagttcagaaactttggcgtctacggcttgcagaaattcctgcttatgcgccgcgtccatcttctgccaggtatgacgtaaaaaatgctccagcagttgctgttctatttcaaacgtcgacatgcttttatctgctttaagttttagccgttttgcgacatccagcagaatcgcgcggtactgttttccgtgtccgcgcaatttgttggcgatactgtcgccgccgtaatgctgaaactcgccggcaatgagctgccagttacggcggtgttgctccgggtgaccttccatcgctttgaacagctcgttatgactaaggacgctcgacaagcgagctttgcccttttcgttatgcgtcagcaaacgggcgaaatcggcgagttgttcttcgctacaatgctgaagaaagtctaaatcctcgtcgtgtaaataggtgacgttcattttcagtctggcttttggaatagaaataacagcgattaatcgtcgccaatgactttaagtctcgccatatcggaagaatttaccgtatgacctgagaaggtaatctttgatacgcagcgtttgttgtcgttatcgctattaatattgatccagcctgtcgtctggccttctttgattgaggaagggacgttcaggctttggctggcgctacgcgcagttttaaaatagacggatgcgccgctaagttcgatatcgccgtgatccgccgtgagttgaatgcgcttcacgatgcggcagacgggaattttcagcgcgagatcgttcgtttcatttctgggcatggcaataacacccagtattttatggtcgttcgcgtgcgcgacgctacttaacgccaggccgaaaagcaggccgacggaaatcgttaacacagatcgcatgaaatttctctttgacgggttcaataagcaattaccgtctatcatactctgctcatgacaacgattcagttttgtaatcttttctttttattacaatttttccgtgaatggtattcgttgtttaatttattttatgaatgtttacctgtctggttttccatcgcgccctctcgtcaataaaaaattttttcatctcccccttgatgacgtgggttacgaccccatcttgtagtcaaccgcagtggtgagtctgaaaaaaaacgattcagggtagttgaaaccgcacgtttcgcccttattacagattcacaaccacatgatgaccgaatttttagtggagacgtttagatgggtaaaattattggtatcgacctgggtactaccaactcttgtgtagcgattatggatggaacgcaggcacgcgtgctggagaacgccgagggcgatcgcactacgccttctatcattgcttatacccaggatggtgaaactctggttggtcagccggctaaacgtcaggcagtgacaaacccgcaaaacaccctgtttgcgattaaacgcctgattggccgccgcttccaggacgaagaagttcaacgtgacgtttctatcatgccgtacaaaatcatcggcgccgacaacggcgacgcatggcttgatgtgaaaggtcagaaaatggcgccgccgcagatttctgccgaagtgctgaagaaaatgaagaaaacggctgaagattatctgggcgaaccggtaactgaagcggttatcaccgtaccggcttactttaacgatgcgcagcgtcaggctaccaaagatgctggtcgtatcgcggggctggaagttaaacgtatcatcaacgaaccgactgccgcagcgctggcttacggtctggataaagaagtcggcaaccgtactatcgcggtttacgacctcggtggtggtactttcgatatctctattatcgaaatcgacgaagttgatggcgaaaaaacctttgaagttctggcaaccaacggtgatacccacctgggtggtgaagacttcgatacccgcctgatcaactacctcgttgacgagtttaagaaagatcagggcatcgacctgcgtaacgatccgctggccatgcagcgcctgaaagaagccgcagaaaaagccaaaatcgagctgtcttctgcgcagcagaccgacgtgaacctgccgtacattaccgcagatgccaccggtccgaaacacatgaacatcaaagtgacccgtgcgaaactggaaagcctggttgaagatctggtgaaccgttctatcgagccgctgaaagtcgcactgcaggacgctggcctgtccgtgtctgatatcaacgacgtgatcctcgtcggcggtcagacccgtatgccaatggtgcagaaaaaagtggctgagttcttcggtaaagagccgcgtaaagacgttaacccggacgaagctgtggctatcggcgcagcggtacagggcggcgtattgaccggtgatgtgaaagacgtactgctgctggacgttaccccgctgtctctgggtatcgaaacgatgggtggcgtgatgactccgcttatcaccaaaaacaccaccatcccgaccaagcacagccaggtgttctctactgcggaagacaaccagtctgcggtaaccatccatgtgctgcagggtgagcgtaaacgtgcgtctgataacaaatctctgggtcagttcaacctggatggcatcaacccggcgccgcgcggtatgccgcagatcgaagtcaccttcgatatcgatgctgacggtatcctgcacgtctccgcgaaagataaaaatagcggtaaagagcagaagatcactatcaaggcgtcttctggtctgaacgaggaagaaattcagaaaatggttcgcgatgcagaagcgaacgctgaatccgaccgtaagttcgaagagctggttcagacccgtaaccagggtgaccatctgctgcacagcacccgtaagcaggttgaagaagcaggcgataaactgccggctgatgacaaaaccgctatcgagtctgcgctgagcgcgctggaaactgccctgaaaggcgaagataaagccgctatcgaagcgaaaatgcaggagctggcgcaggtttcccagaaactgatggaaatcgctcagcagcaacatgcgcagcagcaggctggctccgccgacgcttctgcaaacaatgcgaaagatgacgacgttgtcgacgctgagtttgaagaagtaaaagataaaaaataatcgccctttgaacgggtaattactggcacgggcgaagaggtttcctctccgcccgtgtatgcatgttaagggcagataaaaagagatggcgaaaagagattactacgagattttaggcgtttccaaaacagcggaagagcgtgaaatcaaaaaggcgtataagcgcctggccatgaaatatcatccggaccgcaatcagggtgataaagaggccgaagctaagtttaaagagattaaagaagcctacgaagtgctgaccgatgcgcaaaaacgcgcagcctacgatcagtatggtcacgccgcgtttgaacaaggcgggatgggcggcggatttggcggcggctttaatggcggcgctgatttcagtgatatctttggtgacgtttttggcgatatctttggcggcgggcgtggtcgccaacgtgcggcgcgtggggctgatttgcgttataacatggatctcaccctggaagaagcggtgcgtggcgtgaccaaagagatccgtattccgacgctggaggagtgcgacgtttgccacggcagcggcgcgaaagctggtacgcaaccgcaaacctgtccgacctgtcatggttctggtcaggtacagatgcgccagggattctttgctgtacagcagacctgcccacactgtcagggccgcggtacgctgatcaaagatccgtgccataaatgtcacggtcatgggcgtgttgaaaagagtaaaactctgtccgttaaaatcccggcgggcgtggataccggcgatcgtattcgtctggcaggcgagggcgaagcgggcgagcatggcgcaccggcaggcgacttgtacgttcaggtccaggtgaaacaacaccctattttcgagcgtgaaggcaataatctttattgcgaagtgccgatcaactttgcgatggcggcgctcggcggtgaaattgaagtgccgacgttagatggtcgcgtgatgctgaaagtaccgagcgaaacacaaacgggcaagctgttccgtatgcgcggcaaaggcgtgaagtccgtacgcggtggcgcgcagggcgatttgctgtgccgtgtggtagttgaaacgccggtcggtctgagcgaaaaacagaagcaattgctaaaagatcttcaggaaagttttggcggcccgacgggagagaaaaacagcccgcgttcaaaaagcttctttgacggcgtgaaaaaattctttgacgatttgactcgctaacctttttcccgttgtatttttcttcagcccgggtgtatgtatatccgggctttttttctgcctgtacgcgcccaggcttctgctaaacgcatcgtatcctctcatttgttggtattttgttttactgataaacaaattgatgttaatcagcaggtttgcatacgctcattttaaaaaaaaatgtaatgtgatgacattaacgattgcttttttagacgctgtgaattgatttatcttgagtattatctatattgctttttttagtttccggaggcagacagcgaatgggatcgaaaggtgccaacaagagctttgattataatttaatcaaaattcttgacgctgttattttgtcaggaaatgcggctatggcggcaaaaaagttaggcattacaccggctgccgtttctctggcgttaaagcgcctgcagagttattacccggaagaactgtttagcagagggaaaggcgggctcatccccactgctaaggctgtcgacattcaccaaaatttcagtcaggtgatgaaactggtggatgacacatttctctgtaatagcaaaaaagatgaagcgttccagataacgttattaggcagtgatattgttgaaagctattatctttctcagctctataacagcgatatatttgaccgtattttgataaatcatttctccgtcagaaatatgagtcgggagcatatcagcgaacttctgtttactgcgcaaggcgatctgttgattagtgccgaacctttgctggagtccggcatagagaatcaaatcattgatagttttaaatcatttgtttgtatctgtagcagtaaacacatgctgagtaccctctcgcaactgtcgctacatcatttttattcttcgcgtcatgcgttatatcagccggggatgggggcttcagtgatatatcatgatagcgagttatttaaggatgagctttactatactggcaggcgtattgtcggctatcgtagtgattcacttaacggtttgatgagcatgatcgaacgaacctcattgattgcattgatgcctttgaaattagcgcttttttataaaaatcatcgtaaatatgacattaaatttattcagcctccgcccgaactggcctttaagtcagttcaggtctatgcatcctggaagaaaaatagtagaaatatatcgacgattaatgagatggtaagtatgttgcaaacactttcctccttccgtcgctaacacacctcatttttacgctttgatttaatatggttttaaatgatgtgctttgatttttacccttctgacagggcgcttacactccttgtgttaattattcatttataatgatttcggggtgttaaaatgtctattcccaaccatgtgtcgacaacggaagttgtgctattggagctagagatcttactcactattatttcgattggcgcgtggggaggctttgttagctatcttttacgcaaagataagacagaatataatagttctcatgaaagtattaaatattgcttaacgcagatcgtgatttcctgcttcaccagctttttgttaagcgcgattgcgatcgaaaaagaatgcagtttcaatattgtcctgttggcggcaggcttaggcggtgttttcgcgagtccgatcttaaaaattcttgggcggcgaattaaaaaaattatcggaggaaataattcagattaattgtcattcgcaatatcaggctcatccgtgagccttttacgcgtcttttttcagcctggtctaggtcactctgttcttgatccagccataaataaattgttcgttattgtggtttttctcagcaacgtttaagtagtacatgccctgactgcaattgagggctttcaccaaaacggcttccccttcctggcctcgccaggccaaataatgttcgagagcggcaagcgtccgcgggccaatattgccatccacatgaacatccgggtagcgtttaccttcgtgattaaagacgttcagccagcgttgcagccacgcgctggggtggtaatcgcctatgttgactgccgcatcgcacagctcgaatgagactggccacgatagcgtcgagatgacatcaaagcctggttttatccagtaatcctcttcgagaatcgcgtaggcttcagcgtgggtcagatcccgcatatcgccagcatagccatgcgctcgcgccgtggcttcggtaatgccccaatgagtggcgccgcctttatctttagggttaaatacgtaaccgccttcaagcgcaataattccatctataattggattcatcttccctttccttcgcttagtgaatatgcagatacatgagagaacctaacgttactgaaaatacggtcgtcagggcagcgatggtttgccgtacaatctgtttttttcttccctttgtttcgctatccgtcgcgataatggcgatatcactattcactttgagaccttgtcttggaatggtaataaaaagatcattaataccaagcgctttaaggtcacgtctgattaaatagagaatctgcgttagatttgcatcattaacatagtggcttcgacttccccataacgcagtggttattttttgtcgctcgataatctccagatgagcattctcgatgatgaaactgagacatttggctctcatcgcagtcattttaataacctgtgaatttgagaccgtcctcagttcatatttaccttcattgtaaatgcaattgctattaatgatataagttttcataacgtcttcctttagaaatgtacatcctggttgtctgtggtgactatattgtatgagaaatgtcttaatccaataaatgtcactggttttattgtattgtcattgtctatagcgagtgtaatcacattatttcattgtaattaaatgatatttaattacatgataaatgatatttactatgttctcaccagaacggagtaagcgggcgctgagaggtgttgttttctcttcgtcagacggtgttgttaacctcatttttatgatttttatatcatctaaaaaggtgatgttttgtgattagctattttttatgcctgtagcgattatggaccccgcagaacgagctgcgacaattttgaaacgtaaaaggaaatttgaaaatggctacaagcaaactgattcaaggcgatacgattactgaaactacccatgcagcgaatggttttgaccctgcaacaagcgatgataaaataagctatacttccgctcgtgttgcgaaaccggtatacaataaatataaaaattccacgactaagccgaaggtattcggttattacaccgactggtcacagtatgacagccgtctgcaaggcaatatgtcccaaccgggccgtggttgtgatttaaccaatgtttcaccgacggcttatgacaaactgatttttggttttgttggtatcaccggtttcagaaaaattgataaagaagaccgcgacgtcgtagcagaagcggcagcgctgtgcggcaaagtgaaatatgagccgaccttcctcgatccgtggggcgatttccagtcttatatcaacctgggttttgaaaccagcggctgggatgttgatccgaaaaccgtgacccaggctaacgctaaaggtatgctgggcgcgctgcgtgatatgcaggcaaaagcgaaagctgcaggtcacacgctggcgctctccatgagtatcggcggctggagcatgagtaacgggttccacgaaaccgccgcttctgactcttctcgtaaaaccttcgccaaaggcgtggtgaaactgttcaaacagttcccgatgttcagcgaagtggatattgactgggaatacccgaacgatgaaggggcgggcaacccgtttggcgcagaagatggcgctaactacgcgctgctgattgccgaactgcgtaaacagctggattccgcgggtctgagcaatgtgaagatctctatcgcggcctccgcggtgaccacgatttttgatcacgctaaagtaaaagatctgttggctgctggcctatacggcatcaacctgatgacctatgacttcttcggtacgccgtgggcggaaacgctgggccaccacactaaccgcaaagcgctggaagagggcggctgggctgtcgaaaccatcgttgatcacctgctggcggaaggtttctccgctgaccgtatcaacatcggttatgccggctatacccgtaacgctcgtcaggtagaaattgaatccctgtcgccgctgaaaggttcttacaacccaggttcaggcgatactaccggttccttcgaatccggcaccagcgaatggtatgacgtcatttatagctacctggatctggaaaaccagaaaggccgtaacggtttcaacgtttacaccgaccaggtcgctgacgctgactacctgtatagcccggaatccaaactgtttttatccctggatacgccgcgtactgtcaaagcaaaaggcgaatatgcagcgaaactgggcctgggcggcgtgtttacctggactatcgatcaggacaacggcgtgctggttaacgccgtgcgtgaaggtctgggttatgaaatcgaatctgaagttatcgatatggaaccgttctacttcgaaggtatcaatgtagaaaaagatgacgagcagagcgatagcgacgacgcgcagaaggtcaaccacgcgccgaaagcggcgattgaactgatggtcgtaggcggatcgacggtacagctgtctggcgcaggttcttctgatgaagataacgatgagctgtcctttagctggggcgtgccttctcaaatcgatgtggcagacaaaacggcagaaatcattgaggttgtggtaccggaagttagcgaaaaaacagcctttcagttcaccctgtttgtacgcgactgctacaacgaaccgtcctctcaacagcgctttgttctgacggcggtgcctgcgctatctcaggttcaaccggaaccggaagaggaagaagagattatcgttcctgtaccggacgaggaagaagagaccacgccggctgaggatgatacgtcagcagatgacaaaacgtcaccttacgcgcagtgggatgcttctaccgtttatggcgcaaactggggttctttcgaaatcgttagctggaaaggccataactatcaggtgaaatggtggtctatgggcaaccagcctgacctgaactgtggtgtcggcggtgcatggaccgatcttggcgcttactaatacacggtattaagccgatgtattgggcttcatgattcaagccccggtttaccggggcttttctccaccagggacagaggaagagcagaccatgaccatttccatccatgccagcgcatttgacgtcaacagctggtatcaaaaaatcaccttaaccttcatcaatgagagcggtaatccggtcgatatgaaccatgccgcaatatcattcacggcttccgggcacatcgatccatggggaaatagcggcggtacgctcaaagggaacccgccgcttacgctgaatgatagttcgtatggcacgctggaaactaacaacatcatcattaataacagcgatgcattacttcttcagccgggcgaacgcggaacgctctctttcagcctcgcggcgacgcaggtgccggtaaaaatgtccgccgtcaccttgacgctggcgtcatcgtcatccgaagacgcagagtctgcaaccccatccgatcaggagacgccagcgatacccgccgcagacgaacaacccgccgaatccgatgtgccggaaaaggacaatgaccttcaggaacgcggccttacgcttaacgttagcgagttgaatgccgcaagttggtatcaacacgtcacctttacgctgaccaacctctacgcccaggcggtagatctcaatcagcttcaactgaattttacggccagcgcgcaccccgatccctacagtccgtttcagggaacaatgctggggaatcaggccgtgacgctggccagcgatgggggatggcccatcgagaagaataccatcaccattaatcatgacggcgcgctgatgctggcggcaggggatatcgccgaattacagtgctatctggccgccacgcagacgccagttgccatcagcgatttgaacgcgacgttggcccatgaccctgcccaccagggaaaaatttgcgttcactttcctgccatgacgcagaccgtggcgctcaaaccggtgattgagctactgtttcctgccggcgaaacccggcgctttgtcggtgagtggggagaggttctgacaataagcgatcttagcgcaggaacgtatcggcttatcgtaccggtactggcgaatgatgagatgcaaatcgcgccagtcgagtcctcttttaccgttacgctgcaatccggagatgccgccgcgcaggtctaggtatcttgtttaccgattgtccattatgccagcgcgcgtctgatgattgatgcccctgcgcttggtaatgcgaaattgaccgttgaaatcgccgatgctacgcaagcggatgagcgtaccgtcacgcttatcgccaaccaaccgcagttaatcacccggctactggcggggcatcattatacggtcaatctgcagcctgcgatgattaataaccgctttatatcggcacccatacagcttacgggttttatccctgctgcggcgcaggttgccgaggttgctgtcgcttaccaacagtcggcgctcgacacggcgagcttcgtgacggtagatgccactatactgggcctgcccgatggcgtcgcgccgcagcgttatctgttcagcagcggtaaatatcaatactcattaatgctggagagcggcagcgatcggcagacgctgtcattacgctttgcgcccgggctgtatgatgttcagacggacgatattttcatcgacagtgtgccgtggcgttgtgaacaggccgggccgctacgcttgttgcaaaaggtcaaccatgtggcgctggagtttctgcccggcgtgacgctacaggtaaaaggttggcctgattaccttgctcatggcggcgtgacggttaacgcgccagagacggtttctctttatcgcgatataccgtttagcgcgttgtttaaatacgacggttttgacggcggcggcgatccggtgccggccgcagaggttgacgtgaacggggatgtttttctggattacgcgacattaccgatccataaaaccgttgcgctggtgcgccagatcgaaaaagaagccgggcgtagcgtcatgccggtaatggtcatttataccgcgaatgccagcggcggcagcgcgctggtggatttacaggatgcgcaaaagctacgtaaccattttggtaactttattacccagtgtctggcggcgcagtcatacaaagatgagacgcatcctgtcccggccacctttgtgcttaacccggattttctgggtgcgctacagcaaggaccgtatggctataccgtagtacggcaaaaaaacagtgtgccggtgaatgcccaactggcggcggcgatacaagcattaccggcgatggctggctttatcgcgccttcgttgccgacgtttagcgacgatctctacggttatattcaggcggtgaactatcttgttcgtcagtttgccccggatgtggcttttggctggcagacgaatgtctgggcgacaggaacggcggactgggtgctgcgcgataccgctgatccggtagctgaagggcaggcgatcgccggatttattcatgaactgggcgtttatagcggagaatatgcgccggactttattgcgtttgatgaatttgagcgtgactgtttcagtcctgatgcgcttgcccactatggctggaatgcgacatgctggcttaattacctggcgatggtaaaacaggtgacgaaagcgctgctgacgcccgccatgctgtggcaaattcctggcggccatatgcctacagtagaagagggcgtcagcaaaatcagcgctgcgcactttgcatccggcggaaccttttttatgggtgacgcccgcattggcagcgatcctgacacgctctctttgcagctactcaatacggccttaaatagcgcgacttacggcgtcccgaccgtcggcgactttttacgtaaagataaagggtatgactggggccagatgcaggcgctgaacctaccggactttaacgtcttttcgatcttatggggcggtggttctactatcagtattacgacaatccattctaacggtgaagacggcggctggctggcggataaaatggtagagtattatgctgctccacgctattttagataatatcactgcttatttgcattaatctggcctattagtttgagattcgaaggcgcgttctttcgaatctcttttcctgcgccccctgacctctcattctttatgcgtaattcgttattaattttctgtaatcaatttgtattaagaatcgtcttaatcttaaaaatattgcgtattagtgcgttgtgaatacagaaatactgcatagcgatgttatttattattaatttaagtactttttgagaggttatactgtggcgctacattgagtagacaaccgttaatgaaaaaaatgatgaacgacgcttttgctaaagataataatgagaatttattacactcttttcttttttctcagcaggctaaacctcacgcggcgattgatgccttattttcggccttgttgccatttggtcaaccgtttacgctgggtatcggcgatgagttttatttacaggccaatgatgaacactacattgtattactggagtcaggaattgtttctttctgtcgtgatgacaaccgactccatatatcttcatcgtttgcgccatcggtcgtgggtatggttgacagctatggcgctacctataacgttcccgcgcgcccggaacactttttgctcgcagaaacggtttgtagcggtagatttgttcgcctgccggattttataaaaatcgccgatgaatgcgatttgtggcacgacgtggcccgttgtctggcttaccgtctgatggtgatgagcgcgcgcgatcgtgaattagtcggcgtcgattcttacctgaaagttcgggcgctgctgattgaaatctgggcttatccacaggcctaccgggaaaacattatcgtattgaattttattcaacggcgtaccgggatatcgcgcagtcggactatgaagattctgtctgaactaaaaaaaggcgggtatatccatattgataatgggcggctgacggcactcggaaaactgccagtggcgtattaatgcactatacgcaacgatatatttacatatctcaactgaatttgcctgttatcgttaataaaatgttttattgaaaattgttaagaagattatttttaaaaagtcaatatgactaaaggagataggccgaacggctggtgtaaagtcaatataaaacaacatgttacatctagtcctttaaaaccaaatgtcgatgattgcaacttgccgttggcttgctaataattaataacatcgttatctcattataacgtaaagattaactcacgacgttgagtagctgttttattgcctctgacatttatatcagaacaagaagacacttttttcgcataagaaaagtcgtgatattgctgtgaagaaatatcagcagccgtttcgttaaaaaatctgattaccctcatttttatatttaaaaggagcttgaatgaaaaagcctgtactagcattaatggtctctgccattgcctttggcggaatgttgtccaccgcgcaagcggatactacaaccgtcactggcggtacggtaaattttgtcggacaggtcgttgacgccgcctgttctgtttccgctgactctgtcgatcagaccgtgacattaggccaggttcgcgccagtaaattaaccgaggccggtatggcggcgaatcaaaaagaagatttcaccattaaactggaagactgcgatactcagaccagccagaatgcggcggtgatttttaatggccagcaggacgcaaaccagccgggttcgctggcgaataccgctggggcaggttcggcgacgaatgtggcactacaactttatggaccggatggccaggcgctgaatattggtgaatcgtccagtactgttaccttgaacgatggcgaaaacgttattccgcttagcgtggattatatcgctaccggtacggcgactgccggtaatgttaccgcgacggcgacatttagcatggtttattcctgattccttatcgggatttttttctcgtctgttgggaggcgagaaaggggcgttacgcgcgtcactgcgcgtaacaaaccgacggcatcaggatattacgcagatgaaaaaaaacgtaccgattttccttcgattattgctactgctgtcggcggccggcctgtcgtttgccgtgcaggcgggaggcattgcgctgggcgcgaccagggtgatttatccgcagggaagtaagcaaacctccttgccgattattaattcttctgccagcaatgtttttttaattcagtcgtgggtcgccaatgccgatggttcacgctcgacggattttatcattacgccgcctctctttgtgatccagcctaaaaaagaaaatatattacgtattatgtatgtcgggccgtcattaccgaccgatcgcgaaagcgtgttttatttaaacagtaaagtgataccctctgtcgataaaaataaactgaccggcaactccctgcaaattgcgacgcaaagcgtgattaagctatttatccgcccgaaaaatctggcggaggcgccagcccatgccccggcaacgcttcgctgccgtaacgagcgcggccagctaacgattactaacccttcgccgtactacgtttcgatggttgaactgtacagcgcggggaaaaaactgccgaatactatggtaccgccgaaaggcgcgatcactctcccggcgacgcctggccaggtatctttgcgcacggtaaacgattttggcgcaacgacgccagcacgcgtttgtccagcttcatgatgttatgcgtaatcagcttttcatgacgcgatattactccagcgtagctaaacccgtattaactccgctggcgttggctatcgcactggcgcctgcgcctgggtgggcggaaaactatttcaacccggcatttctgtctgacgacccgtctgcggtggccgacttatcgaccttttcccgtaatgcccaggcggcgggaatgtatcgcgttgacgtttacctgaacaatacgtttctcgcgaccagagacattgccttccaggcggtgaagacgacgggaaaaagcgcgcccaccgatgacagcggattacgcgcctgcctgacgcctgaaatgcttaaaaatatgggggtaaacaccggggcatttccactgttggcgaaggcggcggcgggaagttgtccggatctcgccagtgcgataccggccgcccggacccgctttgattttgcgcagcaacgtctcgacattagcatcccgcaggcggcgatggttgccagcgccagaggctatatcccaccgcaatactgggatgaaggtattaacgcgttgctattgaattacacctttaccggcgcgaatagtcaggatcggagcccaggcggcagtgcggagaacagctattttcttggattgaatagcggccttaatctgggggcctggcggttacgcgactactccacatggaacgcgaatagcggcgatcagaatagcgacagcgactggcagcacatcagtacttatctggaacgtgatgtggtctttttgcagggagaactgacggcaggcgatagttataccccctccgcattattcgatagccttccttttcgcgggctacaactggcgtctgacgacaatatgttgccagacagcatgaagggcttcgcgccgaccattcacggcattgccagaagcaacgtgtaagtgaccattcggcaaaacggctacatcatcaatcagcgctatgtgccgcccggggcatttactattaatgatctctatcctaccgccgccagcggcgatttgactgtggaagtcaaagagtccgacggttctattaatcgctataacgtgccctattccgccgtgccgattctacaacgagaagggcggctgaagtatgcggcgacggtggcggagtatcgtagcgatagtagtcaaaaagagaaggtgaaattcagtcaggcgaccttgatatgggggttaccgcatggttttacgctgtatggcggaacacaactttccagtcattatcacgcgctggcgatcggcagcggcgcaaatctgggcgactggggcgcggtgtcgctggatgtcacccaggctaccagtacgctggcggataataactcctaccaggggcaatcgctgcgtttcctgtatgccaaatcgcttgcacagtcaggaaccaatttacagcttatgggctatcgctattcaacctcgggcttttacacgttggatgataccacgtggaaacggatgagcggctatgacgatgacaatcggactgacagcgataaaagcaggccggaatgggcggattattacaatctttattataccaggaggggcaaagtacaactcgatatcaatcaacagctaggcgggttgggatcgctttttattaccggcagtcagcaaagttactggcacactgatgaaaaggattctttgttgcaggtgggatacagcgatacgctggcgggtattgcatggagcgtttcttacaacaataacaaatccgcaggcgatgcggagcgcgatcaaattttcgccctgaatatctcggtgccgctaagtcaatggctgcaacatgatgatgaggtcacgcaccatcacaatgtttacgctacctttagcaccagtacggacaaacagcataacgttacgcagaatgcgggccttagcggcacactactggacgaaaacaatcttagttacaacatacagtaaggctatcagaatcacggtattggcgaaagcggcgccgccagcctggaatacgatggggcgaaaggcaacgccaatattggctataacgttagcgataacggcgattaccagcaggtgaattatggcctgagcggcggcctggtggcgcacgcgcatggagtgacgctaagccagccgttaggcaataccaatattttgattgccgcgccgggcgcagccaatgtcggcgttgtcgaccagccgggtattcatacggacgcgcgtggctatgcggtggtgccgtatgcgacgacatatcgccaaaaccgtatggcgctggacgttaacgccatggctgatgatgtcgatattgatgacgcggtgactcgcgttgtgccgaccgaaggcgcgctggttctggcccgctttaaagcgcgagtcggcgtgcgtgccctggtaacgctgaatcataatggtaagcctgtaccctttggcgcaacggtgacggtgaatgatcgccatgcggaggcgattgttgacgaggccggggaggtctatctttccgggttgtcagcgcaaggcgttctgcacgttcgctgggggaacctgccggatcaacagtgcgtcgcgtcctatcatctctcttcctcccgtcagattctgagtcgacaatatgcggagtgtcattaaatgaaaatacctcttttatttgctctgctggcggggagtgtcgtatcgcagtacgcacacgcagacgtgtgtaaaaacgttaacggcgtgccttccagtattaattacgatttaacgaccactctgacggcagaacaaaaccaggtgggaaagacggttcaactggaaaaaagccaggaagttaatgtacaggcggtgtgtcccgccggcgcgtcgacctatagccagacttatcgctcctatgtgtcgccatatccggtcgtagaaacgagcggtaactggaaatatttaaagctgggcccggactaccttgaaggcggaatgcgaattgaggattcttcggcgggcgatatctatccgccaatgaacaatgtcctgatgggatatgatgaaaatgtgaaagcgggtcaaccgttttacgttcgtgactcaaatctggagtttcagctcaaaattgttaaaccgttcgtcggcacggtgaatattagtcctaagactatgttcaatgtttatgtcatgaccgccgcaggcgatccgctgacagatgtcgtgtacagcattctttatagtggaacggtgaccgtaccgcaaagctgcgaaatcaacgccggacaaacgattctggtgaatttcggtgcattatacagcggcaatttcaaccatgcaggccaaaagccggagggggtacgagcgaaaaaattcagcgtaccggtaaagtgcagcggtctggattcgcaggtcaatttaacgatgcgtcttatcgctacgccggatagccactttccccaggctatcgcttcggataatgccgatgtcggtgtagtggtcgaaaccgatgaaggaaacgcgcttattcccaatgatgtacagagcgtcgcgccttttatcaccgatagcgccggacgcgctaacatcacattgcaagcctacccggtgagtacaacaggtgaaacgccagcggaaggggcgtttaccgccctggccagcctgcgagtggactttgactaaatgaacagatcacactgcgctctttttgtcatgggactaatcctgtgtccacaaatcaatgccagcgctgacgacctcgcttataacctcgaatttaccggcactattgtggcgcaaacttgcgacatagatatttccagtctcagtcaaagtattgatttagggcagtttgcagttggcgattttccttcgacaggaacaacgacaaaatttaagccctttaatatcaacctcaaaaattgttcccgaggaattaccggggcgaagatctggtttaccggcgaacccgatccggacaatcccgcgctactggcaataaccgataccggaatgggaagcggaaacatgttagcaagcggggtaggggtggaaattctgaatgatgatcaggataccatcagtatcaataatgccgactcagtggtctatccgttgaaagccggacgcaacacgctgtctttttatattcgctataaatcgacccggccgacggtcacgtccgggaacgcgacggcggtcatgtatttcgatatgcagtatgaatgaggagccatcgtaattatgcgtaacgatatcctgtacggcatcgggatgctgctggcggcatccggcgtccaggcgcacgatggccgggtctatgtctccggaaccatcacggacaatacgtgttcgctctctccaggctcggaaaatattaacgtggcgatgggcgcggtttctcaacggcagttttatcgcgcgggcgacggttccgcctggcaaccttttgctatcgatttacagaactgcggtagcactgccagcggcgtaacggtcagttttagcggtgcaggggatagccgtaatacggatttattggcgcttaccgcaggggaaagcgacgcttcaggaattgggattgcgctttatgatcaaaataaaactttaatcccactggggcaggagagtgatgtggtgacgctcagtccgggccaggcgtcggcgcatctgcaattttacgcgcgttatcttgccgatggcggcacggtaacgcccggggacgccaatgcctccgcaaccttcattcttgcctatgaataagttctttttacactgcgcgatatattggtgcttgcttcccatatcatgggcgcaggctggcgtggtaattggcggtactcgctttatctatcatgcgggcgccccggcattaagcgtaccggtaagtaaccattcagaagcgtcctggttaattgatacgcatattttacctggtggccgctggcctggaaccaaaaacgaagggaatattacgcccttcgtggtcacgccgccattatttatgctttcagcgcgccaggaaaactcaatgcgggtggtttataccggcggaccgctacccgccgacagggaaagtctgtttaccttgagtatcgccgctattccctccggtaaaccggaagcgaaccgtgtacaaatggcgtttcgttcggctttaaaattgctctatcgccctgagggactcgccggcaatccgcagcaggcctaccggcatctgatctggtcgcttacccccgatggcgcgacggtacgcaatccgacaccctattacgttacgctctttttattacgcgctaacgagcgcgcccaggacaacgccggggtcgtggctccctttgcaacgcgtcaaacggactggtgccggcacgcggttcgctgcactgtgcgctggcaaagtattaatgactatgggcgggtaatgacagcgcaaaccgtggatctgacgcgtattcattaacctatttttcaggcgtctcccgatagcgggaggctttccgatcttatcgaacgagacttttattatgtattatcacgcgttaaaactttcccgactggcgatgttgacgttggcaggcgttgcagtatccgcctcggcaatcgccgccgattctgccccgacgtcgcaaattggcccgacggcggaagcctacatcgtcagtcatccggataaagtgggagaggtggtggcaacgtatttggccgaacatccggaatttttggtcgccgccagcgagacgttacatcagcgtcagcagattgcgcaacaacaggcgtatgttcaactggcattacagtatcgtgctgagttgctcagtagcagcagtccttccgttgggcccagcgaggcaaaagcggcggtggtaatgttctttgattaccagtgctcgtggtgcagcaaaatggcgcctgtggtcgaaaacctgattaaggcgaacccggatactcggtttattttcaaagagtttcctattttttcctcccgctggccggtatccggactggcggcaagagtcggcgaacaggtatggcttacacagggcggggcgaaatatctcgactggcataatgcgctttatgccacagggaaggtggaaggcgcgttaacggaacacgatgtctacaccctggcgcaacattatctaacgccgacgcagctggccgccgtaaaagaagcgcaaagcagcggtgcagtacatgatgcgctcctcactaaccaggcactggcgcagcatatggactttagcggcacgcctgcttttgtcgtcatgcctcagacgcaaaacggtgatgtaaaacgggtgaccgtgatcccgggaagcacgactcaggatatgttgcaaatggcgattcagaaagcgaaggggtgatattcgctcagaggagaacgcacaggagtgaaagtaaaatgaagtctatgcgttgcgtcataccggtgattttactttcctttatcgttcatgaagggacagcgaaaccgaccgctcagattcattttatgggatcggttgttgaggcaggctgctggaatgacgtgggaaccttagaaattcaatgctataataaagagggagttgaacgttatattattgtcgagaatattatcacgccgatatcgtctcctcatgcaacggtaaaacgagattatttggatgaagataagcaattaacagtgctacgcattgtctatgactgaaccgcgtagcagaccgcaggtggtgtcccgtcagtgtcgtgtgaggatattatgaaaaatgttctcaccttcccgggacacggtctacagactttatcttcagataaacggcgctaaaaagaaaagtacgatcaataaaaaaagagtgggaataccaatagatataattttattacatcggtgagtatgatattgaatagcttgtggcggtatgtcagcagcgtcaatgataaatctttcatcgatttttatcccctgcctggggagcgtaacgaacagttcgaaaagcccgatttgttgtaaatctcgtcgcagcagataaagaagttgcgtcaaattagcatcgctaacaaattgacttcgctctccccaaactgcgtgtgaaatcatctcccgcgtaatcagtttcttgtaggcattttcaaaaagatagcttaaacaacgcgcacgcattagcgtcacctttagcacttttttatcatgtaatgatattatttctcttaacgactcattataaataaattcgttattaatagtatattgtctcatgaattcactccgttttgatattcataaggtacgtttcacactgtcagtgtgttcactggcggtaaagtactccttacatcagtacggataagtgtagagaaccgcaaagaaataagagaatcatttgtgattaaacgggataatattatgcttttttacttttttataaaatgtgccagatgtttttgatgttttttataaaatagcatcatgtgtttttattttacacaggctgaaatgatatcaataaaattataatttaataacaaacagatagaggaaatgatttacttattgaaataagtgtggtgcaaggttaatctgcgccttaaatgatggtgccagattataccagccaggataacctatatgcggccaataaaaaatgctaaaaaaattgactacaatctgatcaaagtgttcgatacggttattactgaaggaaatgcaaccagggctgcgaggaaactggatgtcacgcctgcggcgatctctcaggctcttcttcgtttacaaaatctttatggcgaagagttatttatcagaacccgcaaaggattagtcccgtccagcaaaggtaaatcgcttcaccaggtatttcgccaggcaattgaatctatagaaagcacactgtgcgataaaacagatgcgcaggagagtaatgaactcattgttctgggaagtgatatcactgaaaattactattttccggcattgctggatactgtgttgatgaatcgatatattattaaacactatgcgattaaaaaaacaggggaatactcgccagcctccatgctgacgcatggctatgcggatatcatcatgggaattctggaaattaagaatgagatgatcgaaagttttcttattgataatttatctgattttgtttgtgtttgtggtgaaaaaagtccattggttgggcttgaaaaaatgtctttatataatttttatgctgccagacatgctgtctatcattcagatatgttctcttctttcaatgctgatagcattgatttattcaagagcagtacgccttatgcggggcgcagggaaataggttattatagtgattcactatttggcgttatcggtgttgttgaaaaaagcgatatggttgcgattttgccaggaaaaattgctacttattttagagatgtgcggcgttataatataaaaatactacgtatgcctgatgaaataatttttcgtacattacccgtttatgcttatctggctacaaatagcacccattataaaaatgccaaaaaactgatatcaacatttcagtcgacctttctttttagccaggaaaaacagcctgacgctttggttgaaggaagcacatccttatgcgattgatctgtttaatatcaaattactgtattaaataaataaccattatgaccatggtcagtaaagcaaaaaataatgctatatatttatccccttctttttttaaagaagaggggaggtttttgttttcattgctgataataatgttggcatctactttaatacccgttcgaggcaccgtggaaaaaactggctcaagccaaagcctttaaggtcgcgccgcagtagatataaaatctgggtcaggttggcgtcgctgataaattgacttctttccccccaaagttcattagtgagttgttttttataaataatctcttgttgtgcatgattcagcatatattccagacactttatgcgcattgcggcaatttttattatctttcccgtttttatgttttttagctcattggtcttatcattgtaagtgtgcgtgctgttaattaaataaatagtcatgatgttatttaatgggtttaattggggtagcgataataatatgcatattaaatttgtggatcaactggcgtgattgtaatagcgtcttttttccagagaaaatcgtatcgtgtcacaaaaatgatggttttttagaaaaactaaaattttatttttagtcgttctaaaaataaaatgatagtagtgttaatttttatcagtagattgatatgctttgattgatttattgttgacataaaataatttgaattatggcgcaaggcctatgccaaccataaaaaaggtataggctattagtcacaatgcattaatgctacataattgttatgcttttatattagcgccagggaaataaaatcttcggacaataaagaatagttttagtctgggtgttattttatggatattttattttaaattattaaaccgatttctcttgttgacgtagggttatttgctaagcaacgggctggcttgttgtggccgctcgttgtctatatctgaattaataaggaaaaacgtatgaataagaaaaattcgtcaatggttaacttgcccgcaccgcgtgagtcgattaaccagaaaatcgataccaataacgcattggtgttaaatcataacgccatatatgaacaacgattagcggagatcacgcaatctaatacctgtgacaaggccattgtcaccgtaaatccctacgggaccgccccgttgagtctctatctgggaatttggattgatgaagctgccgcgcttgagatcaatgttgttgatagcgaagcgacgacagaggcagtgcgttatcaatatgatgtacatccgggcgctaaccttattcctgtgtgtgggatggtatccgcggtgaataatcagattaccctacgccttgcctcgcaaattgtcgggcaatatacagtaatgactgacgcattaccgcccacggattcggctaacgtgagcctcggcttccccattattagcgtctcctgtcctgcgcagcaggcctcgctgatggaggaagggctttatttctctacttattttgatcggtataatctggcttttgatcataacgggattgtccggtggtatgtaagtcaggaaatcccttcttataattttgtcagaatggataacggccatttcctggcgacgtcacagggaataaaccattgtctgaatatgtatgaatttgacattatgggacgggtttatacggtttatcttctcgacaatgagttccatcactccattcttcccattgagaacaatctggcgattgcgccttcagaatatagcaatggacggccagatggttactcaaccgggaaagatggcgtttctattattaacttatctaccggacttgaagtcgcctattacgatatgctgtatgtgatggattattccagatcgccgcgtccttccggaagcgcgccaggtcaggacgtatcaatggatgactggctgcatatcaaccaaagctatattaatgaacccaacaatttgctgatctgttccggtcgacatcagagcgcgatttttggcgtaaatgtggattccggcgaactgcgctttattatggcgaaccatgaggattggtctgacgaattcaagcaatacttattaactcctgtcgatgatgatggcgtcccgctgtatgatcttacctcgccgggagggattgatgcggcagataagaatttctggacctgggggcagcataacattgttgaaattccaaatgatgagcctggtattctggagtttatggtctttgataatggtaactatcgttcacgcgaagatgcgaaaagtttgttgccgctcgataacttcagccgggtggtgcagtttaaaataaacctaaacacgatgaccgtaacgcgtccgtatgaatatggtaaaacggaagtcgggaaccggggctatagcagttttgtgagcgctaagcatttattgactaatggtcacctggttattcacttcggcgcgacgacggttgatgagtttgaacataccattaccgcgcaaccaggctccagcgatcttgtcgatccggatgaagggcaacaggcgttaggtcgactggtattacaagaaatcaataaagagacgaaagaggtcttattcgaagcgatggtgacgtcgggctatttcaagaacgaagagacgaatggcacgaattatcgttatgatatttctgcatttcgggtatacaaaatgccgctgtttgcataactaagtatgttatgcggccggttatcgaccgcataacattatggcttatttgctaatatcatccacgcgcatggtgtggtcaggttgaatattgttaacctgcttcatatagttaaccaacgccggtgcggtttgtatccctatatatttgatatttttacctttagtgaaggtaaatccgccaccacctttaccgataaaggaatccagcgcgacggtatagagtttattgtcttctaccggtttgcctttgatatcaaattcaacaatacgctggcccagcggtttggtactgtcatatttaaactggacggttttagatacgtgcagcataccgtttttcagatcggcagcgtgtgacatgatggatttcaggtccttaccgctgatttccatgctcatgacatcgttggtgaacggatacatactcagcacatcaccataggtgatattacctttaggcaattcggtacggatgccgccagcattatagaaggaagcgtcggcgccaggaacggtagccatcagggcatcggtgattaagttgccggttggcgcggattcaccgtaagaacgggtcagcacttccggagagtgcgcgaccacttcatcggtaattttcttaaccttgttatcccattcgtcaattttggcctgcgtgaccggatctggcttataagtatccgcatacatggtgatcaacttaccattgtagctgtccacttttttggtttccgggttccagtcaagcaccagtttacctaattcgatggtgtacgcatccgtggaaacgacaagagtatcgcccactttaatcggttctggcgtacctttatgcgcatggccggtaatcaggacgttaagtccatagccttccagcgatttcgccatatcaacgtcggttttcagtgcgcgtgcgacatcagcctcgcccgcgctggactgcatacccggcacgccttcgtgggcgagcagcacggtcaggtcaactttcccttttaactcttccagctgttttttcacataaggaatcggatcgcggcagtcaacgccttcacgcacgcctgcggcaatcgcttcatagaatgcggaaacgccgtgcataccgatgacgccgatcttgaatccatctttttccacaatggtatacggttctttaattaatggcgtatctgtgccgctgtaaaaaacattatccaacaataccgggaattgcaatttgctgagctgtttaaccagattctcatggccatggtcaaattcatggttaccgacagagacggcgtcgtaaggcatggtatttaaaatatcaataatagcctcgcctttggtcagcgtactgataaaaggtccggtgaaatagtcgccagcatcaaagaaaaagacatctttctctttcgcttttgcatctttgacaattttcgagatgggcgcaaagccgcctaccggacgtgtcttggatacataggggataatttctggggttacatgggcatgtaaatcgttcgtataataaattgtgatgtcacgcgcatcggctgaaaaggaaatggctgaagacaaaccaatgcacagcgacagtagggatatcgaaaactttttgttcatataaaccatccatttacgctacattaaagaaaaacaatgcctgtagtcgtgtcattcacgactacaaaccggggaaattaagtaatattcatcaagtttattaattattaaaacttgaagccgatcaggtaattcatacggtcgccgtagccgttataccccaatttattattgaagtaacggtaagagacggaggcggtccatcgcggcataaatttccatgtaaacgttaccgcgccgttcaggccggtcgtcccaccctgttgttcggcgtaggcatcattacgatccatttcaacttcgttccagtttgaaatgacgaacttttcattaaacatatcgaagttataagccgcgacccaaccgagaacataaccgttaaagcctgtcgcctgtccatactttttagaggtataatcgttcgataagttatgaacagcgaaatagggcttaataaagcctgatgggctggttaaacccagataacctaccccgtacatcatgtttaattcatcaccgaatttattctccatcgacatatagagtttcatcattgcggtaaagttagagccttctactaccctataatgtcccagaaattgggtaacatggttacggccttctaccggatggttgagcacgttcatttcataaaatgatgcaaattcgcccctgtcaaacacggcgccgaaatcggctaccgctttccacacttcgccgcgatcgacattgacaaagcctttattccagtcgccatatccgaagctaagtttaccgtatacgcgtttcaattccgctgcctggccattaaagcaagagaaaagaacacatgcggcgagtagactattaatatatttcttatttttcatgctcaactccatgaggtaaaaacacagtgaaatgttgtgtaaagaagcgaattctaaggagtgtctttttatacgtaggtgatagatgtctcaaaaatatcagcgacatataatcgtcaaatattcgtgtcagataatgttgtttattacgtgataactatttgatttatagtttatgtctctgttgtaaaagtcacaccggatagcatgaaattaatgaaacttcgaatgggaataatctctcgcaaagacaacttactgccattaaatgagggtgttaccgttcaaacagcaacatatattgacatcacaatagcggttctgacatatgggccatatttgagatctgcatcactcgttcgcgatttctttttttatagactgcttcaggcgtgttttctttagcacgaaatatatttatggtattaatattataatgagtgtgaataatttctacgataaaacgatgttaatggaagaaatataagataaatcgaatatatatagtgcaattaatttaggctgtattccgcagccgggtctatcggcaaatatatcgtaatcagaccgtgcgataactcaaaggagttgaaatgaaaagaacagtcgttgccagtatgatagggttggcgctatgcgctggatgcgtattatcaaccgcgcaagcggcaaccgcaaagcgtcctaacttagtcattattctggcggatgatttagggtatggcgatctcgccacctacgggcaccgcatcgttaaaacacctaacatagacaaattggcgcaggagggggtgaagtttaccgactattatgcgccagcgcctctgtgttctccttcccgcgcgggcctgttaaccggtcgtatgccgttccgtaccggaatccgttcctggataccggaaggcaaagatgttgcgctggggcgtaatgaactgactatcgccaatctgctaaaacagcagggctacgatacggcgatgatggggaaattacacctgaatgcgggcggcgatcgcaccgatcagccgcaggcgaaagacatgggctttgactatacgttggttaatccggcgggatttgtcaccgatgctacgctggataacgccaaggagcgcccgcgctatggcgtggtgcatcctacggggtggattcgtaatggccaacatattggccgcgcagataagatgagcggcgagtttgtgagctctgaagtggtgaactggctggataataagaaagacgataatccgttcttcttatatgtcgcctttaccgaagtccatagcccgctggcgtcgccgaaaaaataccttgatatgtattcgcagtacatgaccgactaccagaagcagcatccggatctgttctacggcgactgggcagacaaaccgtggcgcggcaccggcgaatattacgccaatatcagctacatggatgagcaggtcggtaaagtgctggataaaattaaggcgatgggcgaggaagataacaccatcgtcatctttaccagcgacaacggccctgtcacgcgcgaagcgcgtaaggtatacgagctgaaactggccggggaaaccgacggtctgcgcgggcgtaaagacaacctgtgggaaggcggcattcgcgtaccggcaatcatcaaatacggcaagcacattccacaggggatggtaacggacacgccggtatatggtcttgactggttgccgacgctggccaacatgatggactttaaactcccgaccgatcgtacctacgacggtcagtctttagttccgctcctgaaggacaagacgttaaaacgccagaaaccgctgatcttcggtatcgatatgccgttccaggacgatccgacggatgagtgggcgatccgcgacggcgactggaagatgatcatcgatcgccagaataaacctaaatatctctataacctgaaaaccgatcgtttcgagacgctcaatcaaattggtaaacagccgcagattgagaaacagctttacggtaagttcctgaagtataaaaaggatattgataacgattcgctgatgaaagcccgtggcgataagccgacgcctgtcacctggggctaatggaataattataaaaaattaagtatgccacttagggcgatgcccacctgatccggtcactctgtgccggatcaggttcttttatttcagggaaggtaatgatgtttgggaaaagttgtcaggtcatggttaaaccaaccggatcggtgtgtaaccttgactgtaagtactgtttttatctggagaaagaaaagctctatccggatcgaaaaaaccattacaaaatgtcggaagagaccctcgaactcttcatcaggcagcagattgccgcacaggatattgatgaggtcatttttgcgtggcagggcggggaacccacattaatgggcatcccgttttatcgtaaagccgttgaatttcagcagcgctattgtggcggcaaaaccatcgtcaataccttccagaccaacggcatcctgatcaacgatgactgggcgaccttcttccgggagcatgattttctggttggcgtctctattgatggcgatgccgcgttacacgatgaatggcgagtgacgcgctccggaaagccgacgcatgaaaaagtagaaaatgcggtgcgttgtctggcgcagcacgacgtagaatttaataccctcacggtggttaaccgtaccaatatgcatcatcctgttcaggtctatcgctacctgaaaagcgttggtagccgctatatgcaatttatccctttagttgaacgctgtggggaaaatgggctggcgcagccgcaggataaacatatcgcgatgacgccgtggtcggtcgatagcctgcaatttggtcagtttctgaatgcggtatttgatatctggatccgtgaggatatcggcgatatcggcatccagctatttgaacagacgctggcggcctggtgcggcctgccgccgcaggtttgcgtttttgctcccacctgcggcagcgcgtttgcgatggaaatgaacggcgatgtttataactgcgatcacttcgtatatccgcaatttaaactggggaatatccaccagaagacgctgcgtcaaatgaatcagggcgaacaaaatcgccagttcggcagcgataaacagcgttcaatggcgcaggagtgtcatcgctgtcaatggaagttcgcctgctatggcggctgtccgaaacatcgttttttaccctctgcgtcaggcgcaaccaatcataactatctgtgtgcaggttatcaggcttttttctcgcataccgcgacggcgatgagtgccatgcgaaccctgtatgaaaaaggcatctcacttgcagaaataaagtcaatatttgtttgaaggtagtattcgcagggagtgaatatgttttctcacattaatgtcgatgcttgcaaaacgccaggctgcaaaaatctggggattctggggagcccagactatctaccgcaagggaaaaatgttctctgtcgagcgtgcggttttttgttccccattatctcagccagatcgcttaatctttttcgccaggcggcgaatcaaccctggaaaggtctggtgaagtcctgtccgcattgtggcgggacgtcgctgaaaaatatggattttccactaaaggtgaacggcgtatgtattgccgccagtgtaataaaacgttcatctcctataccgctatcaggagcgacgccagacaagagaaccttgccacgttgattggcgaaggagcgtcgctagttgaaatacgcgcggcgctggcgatagacagcacgggttttagccgcgaattacaaaaactgtcccgtcgcgctaatcaagcggaacgcgattttgtgtttcccgcgtttgatatcgctatgagcacgcgggcgtttcgtgtgaaatttaacggcggcgacagcagcttatatgtgctggtgacggcggaagaggagagcggtaaggtcgttgcgatctcaacgaattactccgcccaaccggtggaagcggattatcaatatcattctgattacgaagaacgacttccgtccggcacgctggcgcatctggtgcagcgaaaagaggcgctgaccatgcgccgcaatgtattatttgatgtggattacggccccgccattttatataaaaacgatccggggatgttagtaaaacccgtattacctgcttatcgacattttgagttggttcaggcgttgacggatgagcgctccctgaatgtccagcattatctcgatcacgaatgctttattctgggcggctgtatgatggcgaattttagctatcttcgtcaggggcgctgccatatttcgtttgtgcgtgaaagaggcgttacgccgcccaaacgcgatctccctccgcggttgtttttgagcggcggaattcgcaacaacgtctggcgtacattttccacacgggattatgcgatggcagtatgcaatctcacaggaaataaaaaggtgagtttgttacgtcatgcgacgttaaatagcgcgacggcgtttattcgctatgttcacaaccatcccttcctgccgcatcttaaccggatgtctcctggcaatgttgttgccgtactggattacctaaaatttgaatatgacgcttcatgtaactgaattgctaaaataaaaagtgtgatgaggtgttgttgcggtattttattcggacggcttaaaaatccagagtattaattttcgtggtccccatgaggggcgatgagattaatacactggagatttatcatgaatacgttaactgcaacgtctgttgtccttcctgcgccgcgtccggcgattaatcagggtatcgatatcaataatgaaatagtgcttaaccataccgctatttatgaaaattgccttgcgcaggtcacgcaagagaatacggtagaaaatgcgctcatgttgttagacccttacggcacggcacctttaagcgcctatgccggcgtctggagtctggaaccggctgagatcatggtcacggtccaggatgcggcaaaaacggcgatgccggtagaacatctttacacccttacggcaggcgcaaatctgttgccggttctggggctggtagcggagactgaaaaccgtattgtcttttctcaggcagatacgccgcttgccgtctatacgctcaccacacagccgttaccgccggtagattccgcggaggtcgtattaggttttccgattatcaacgtgacgcaacctgctaccgatgtggacaagatggcgccagggttttattttgttacgcatttcgatcgctataattacgcattagatcagaatggtctggtgcgctggtacgttactcaggattatccgtcttataattttgttcgaattgataatggccatttcctcaccacttcagaagcgaaaaatacctatctggatatgtatgagttcgacatgatggggcgtcttcacacattctataatctcgataaccaatttcaccattctatctggccgtgggacagtaataccattgttgcgccctctgaatatacctcgggtcggcccgacgatttgaaaaccaatgaagacggcgtatcggttgtcgatctggctaccggactggagacggcttactacgatatggcgaaggtgttggatacgacgcgggtttcccgtccttcaggtacggcgccgggagaagacccgacggttaaagactggctgcacataaaccagagctacgtgaatgagacgaatcagttgttaattgcgtccgggcgtcatcagagcgcggtgtttggcgtcgatctgcaaacgcaagcgttacgctttattttgtcaacgcatgaagactgggacgacgcttatcagccttatcttttaaccccggtcgacagtgaaggtgtggcgctttatgactttagcaaacaggaggatatcgacgcggccgaccgtgacttttggacgtggggccagcataacgtcgttgaaatcgccaataatacgccgggtatagtggagtttatggtatttgataacggtaactaccgttcgcgtgatgacagcaaaagcctgttaccgccggataactacagccgcattgtccatttcgtggtgaatatgaatgagatgaccgttatgcggccatttgaatacggcaaggagctgggcgcgcgtggctacagtagctgcgttagcgcgaaagcgatccagcagaatggcaatattgtggtgcattttgccgactgcacgtttgatgaaaatggccgcgccatctcttgccagcctggcgagagcgatattatcgatccgcaggcgggcagcgaggcgatggggctgctaattttacaggagattgcgcctacggagaaaaccgtgctttttgaagcgactatgacgtcaggttactacaaaaacgcggaaacgaacggggaaggctatcgctacgatattaccagtttccgggtgtataaaatggatctgtacgcgtagcggtctatcatcaatgactgactgcactaaaaaagtccggcgtaagtcggacttcatttcgtaaaaaacgagctattcatcatatataatctaattttaacgatgagtcaggcgaggtaagatagtagatccgaagaattcacctgattgagagaataaaaagtgaaacatctgcaccgattttttagcagcgatgcctctgggggcatcattctcatcatcgccgctgcgctggctatgctgatggccaatatgggcgcgaccagtggatggtatcatgattttctggagacgccggttcagctacgggttggggcgcttgagatcaacaaaaacatgctgttgtggatcaacgatgcgctgatggccgtgtttttcctgttgattggcctggaagttaagcgcgaactgatgcaaggctcgttagccagtctgcgccaggccgcttttccggtgattgccgccatcggcgggatgattgtaccagcattgctctatctggcctttaactactccgatccggtcactcgtgagggctgggctattcctgccgcgacggatatcgcctttgcgctgggcgtgctggcgctgttaggcagccgggttccgctggcgctgaaaattttcctgatggcgctggcgatcatcgatgacctcggcgccatcattattatcgcactgttttataccagcgatctttctatcgtctcgctgggcgtggcggcgttcgcgattgccgtgctggcgctgctgaacctgtgcggcgtcaggcggacaggggtatatattctggtcggggcagtgctgtggacggcggtactgaagtccggcgttcacgcgacgctggcaggcgtcattgtcggcttctttattccgctgaaagaaaaacacggacgctcgccggccaagcgtctggagcatgttctgcacccgtgggtcgcatacctgatcctgccgctcttcgcttttgcgaatgccggcgtttctcttcagggcgtcacgatggacggtctgacctccatgctgccgttgggaattattgctggtctgctgattggtaagccgctggggattagcctgttttgctggctggcgctgcgtttcaagctggcgcatctgccgcaggggaccacttatcagcaaatcatggcggtcggcattttgtgtggcattggctttacgatgtccatctttatcgccagcctggcatttggcaatatcgatccggaacttattaactgggcgaaattgggcattttgattggttcattgctctccgcagtggtggggtatagctggttgcgcgcgcgtttgaacgcgccggcataaccagtacgaagggaagggggagcgatgtatcgctcccttacgacattgagcagggagagaaatgagcatgtctcatattaactacaaccatctttattatttctggcatgtctataaagaaggttctgtcgtgggcgccgcagaggcgctttttctgacgccgcaaaccattactggtcaaattaaagccctggaagagcgtttacaggggaagctatttaaacgtaagggacgcggtcttgaacccagcgaactgggcgagctggtttttcgctatgcggacaaaatgtttacgctaagccaggagatgctggatatcgtcaattaccgcaaagaatcaaacctgttgtttgatgtcggcgtcgccgatgctttatccaagcgtctggtcagcagcgttctggatgcggcggtggtggtggacgaacccatacatctgcgttgcttcgagtccacgcacgaaatgttgctcgaacagctcagccagcacaagctggatatgattatctccgactgcccgatagattccacgcagcaggaggggctattctcagtcaaaatcggcgaatgcagcgtcagtttctggtgtacgaatccgcttcctgaaaaagcgtttcctgcctgcctggaagagcgacggttgctggtgccgggacgtcgctcaatgctggggcgtaagttgttgaactggtttaattcgcaggggttgcaggttgagatcctcggtgaatttgatgacgcggccttaatgaaggcgtttggcgcgacgcatgatgcgatttttgtggcgccgagcctttattcgctggatttttatgccgatgagtcggtaatagagattgggcgcgtggagaatgtcatggaagaatatcatgcgatttttgccgagagaatgatccagcatccggcggtgcagcgtatttgcaatgcggactactcggcattgtttaagctacagtagacatacctaccgtaatacttccggctgcggaactaacccgcagccggaatcattctacaagttcagtaggctacggtactgcccaccttcgcggataaacaccggaattctgttcagtggcgtagcgtaatgcagcgtctgccctcctgaatagctttcaccggtcgcaagatccgtccatgtttccccttctggtagccagacatcacgttcgcgcataccttcatgcatgacgggggcgatcagcaggtcaggaccaaaacagtactggtcggtgattgtccaacttgtttcctgttcggggaattcaaagaacagggggcgcatcactggcgtattgtgcttatgggtttcctccatcagcgctttgatatagggcttgagtttttctcgcaacgctaggcaacctgtcagtacgtcgcatacttcctcaccgtagctccagacctcgttcggcgcacctgtagggcactgggcgataccatcccgatacggttgcgcgggtaaaatttgcggatcgcggttgccgtgcagacgcatcaccggactaaagacgccccactggaaccagcgaatcagcaattcatggaatttcgggtcgtgaatattaccgccatggaaaccgccgatatccgtcgtccaccacggtatccctgctattcccatattgagtccggcggcaaactggttgcgcagcgatctaaacgaggagtgaatatcccctgaccagaccagagcgccgtacttctgactgccggcccaggcgcagcgtagcaggttgataacctggtcttcgccatcggctttcatgccatcaaaaaaggttttagcgtacatgcgtgggtagatattgcccacttccagtaccggtccggcatggtagcgatagttgtcgtagtcgtaaacgctgaactcaggttcggcttcatctaaccagaatagcttcacgcctttatcgtgatagttgcgtttggctttgccccagacatagtcgcgcgcgcccggatgagtcgcatcaaagtaagtggtattgccgaggaaatccatattgatcggcaagccacgttccgtttgtaccagccagccgttttcacgcatctcccgatagctttcggtgcggttatccaccgtcggccagacggagaccatcagctcaattcccagcgatttcagctcggcaatcatggcatcaggatcgggccagtcgcgcgcatcgaacatccagtcaccctgattcggccagtgaaagaagtcgataacgatcaccgagataggtagattgcggcgcttatattcgcgggcgacctccagcagctcttcctgcgtacgataacggagtttgcactgccagaagcccatggcgtagtccggcatcatcggcggcgtgccggtagccagcgcgtaagcccggccaatttctgccggggtatcgccagccgtgatccagtagtctaactgttcgctgacctgcgcttcccattcggtaacgttttgggcaaaggttacgcgtccgactgccgggttgttccataaaaatccgtagcccagactggagagcataaatggtactgaggcctgggagttacgttgcgccagctcaagcacgcatcctttgagatccaggttggcctgttgatactgccccatgccataaattttttccccttcggtggcttcgaagcgggctttcagtgaatatttcccaccctgaatcgggcggaactcgcgtccctcaaggttgagtgcgctgacgtactggccgtgagatgattcatcctcgccaatttcgccccgcaggcgccaaaactcctgcaacaggggtttgtgtggatggcggtaaaaggtaacttgtcctttttgattgacgatagcgataattttgccgttggtcagcgttgcttggtggtgctcataatcaatgtggcactggctttctgcgactggctcagtcaatgcccagtcttcatttctcattaccggcagatgacggccactgcgtacgcgcaggctgttctcgccccagggttcaatccataaatagcgatcgttttgctgccagaccagacgacgtgggtcttgttgcataaatggcatggtggtgcctcctatattcgagggtgaaggtaaagaacgttatgagttgatggtttccagatcgtggcgaatcttctcttccatcgcttcgtatttgcgaaagaaaagtaatgggatcgctgcgagcgcgaagagtagggcgggtgcccagataaaggcccaggtaattccctccagacccgcagcactctgggcatggttggggacatagccaaaactgttcatgatccaggcggctaaagcagtaccgaggccactacccatcttgatgcagaaggtactgccgaaggcgataagaatgccggtagccttaataccggtcttccaggcgccgaaatcaacggcgaagcccagcatggcaaatggcattgagcaggcgataccgctgccgatattgccgagtatccaggcggcgatgaggaaagtaatgttgtccgctgccagccacatcatgacgccgccaaacgtggcgaccagcagaccgcctacccatatccaggttttagccaggtatttgctaaagaaggggatagcgatgataaacaggatctgaatcgtcgccaggctgttaatcagcggcaccagatctttacggtcgaggttgtaggtcagataatagacaatggtcgtggagcgctgctgtagggcaatccagaagatcagattagccagcaccatcagaatccatggccagttacctttcatcgccgcgaaactttttttcatcggcaacttaggttcatgctgtattttatccgcatccatttcacgaatgtttttaaacgcaaagagcgttagcgcgcaagatataatggcaaatgtaatcgccgtataaataaaaccagcgtgatcatcaccgttacctaaaaaagcgactaacggcaaggcggtcgcgttcattaataaaaccccaatttgcccaccggtcattcgccaggaatttaaaaccagtctttccttgggagataaggtcatcaggggtaatattgcactgagtggtgtattaagtccggtaaatagaatgctggcaatcatataagatattgctgcatagatggcttttcctgttatactgatatcaggagaccaaaatgacagcgcgctgaataccgcaaaaggcagcggtaaccataaaaaccagggacgacatttaccgtagcgtgaacgcgttttatcgatgatgatcccccatataggggcgtctatgccatcgacaatacgcgccagcagcaggataatgcctgctacggcaaggctaatgcccgcaacgtctgtatagaaatataaaatgtacgttgaaccgaagcagtatagcagattacccgccacatccaaagagccgtagctaatacgctgtagtaaagacaatgatgctgacccggaaggctgggtatcctcaatgacagaactcataatgataactccgatattggtacgatacgcccagaaaaacaacctctactttctaagcaagttttgaatattatttttatgtcgtttctgaatttaacctcagattaaaatgagtaagtaaggtgtacatgaaaagtagttaacccgacggcatcaatcaattattaaatcttacatcaggattgcgtttattagtttttaaatgagcgatgtttttatttgctaaggtggtcacagttttttcagtaatgaaataagaaaaggaaaacagtgaaagaaaataactttcaagtattacgtgactaagggagggatagctgaaaaaataggctggcacaggaagagcgtgaacgagtgaggtcagcgccagcggttgacgagaaaaacggcagatagcaggcataaaaaaacccgctttacgcgggtttttctacaaagctgataacaagcaggcgattaagccagtttgttgatctgtgcagtcaggttagctttatgacgtgcagctttgtttttgtggatcagacctttagcagcctgacggtccacgatcggttgcatttcgttaaatgctttcagtgcagcagctttgtcgccagcttcgatagctgcgtatactttcttgatgaaagtacgcatcatagagcgacggcttgcgttgtgcttacgagccttttcagactgaacggcgcgcttcttagctgatttgatattagccaaggtccaactcccaaatgtgttctatatggacaattcaaaggccgaggaatatgcccttttagccttcttttgtcaatggatttgtgcaaataagcgccgtttaaattgcagcactcgttgcgtagtgatggcgcaggattctaccagcttgcgtgctgtgaatacagcctttccatgagaaaaattgcattaagcggcgggttttggggcggagtttgccgcatggcgatgaaaagcatcttctttatgtttcatcagggcaatcgccggttaaccttaaccgctgtacaaggtatactcttgcgattttcactgttttgagtcagacatgaagctgatacgcggcatacataatctcagtcaggccccgcatgggtgtgtgctgaccattggtaatttcgacggcgtacatcgggggcatcgcgctctactgcagggtttgcaggaagaaggacgcagacgcggtctgccggtggtggtcatgattttcgaaccgcagccgctggagctgttcgcaacggataaagcgcccgcccgcctgacgcgcctgcgtgaaaaactgcattacctggcgcagtgcggcgtggactatgtgctatgcgtgaaattcgatcgccgctttgccgctttgacggcgcaaacgtttatcagcgaactgctggtggagcgacttggcgtgcaatttcttgccgtcggcgatgatttccgctttggtgctagccgcgcgggcgatttcttgttattacagaaggcgggggcggagtatggttttgcggtttccagcacccaaaccttttgtgaaggcggcgtgcgtatcagtagtaccgcagtgagacaggcgctggcggaagataacctggcgcttgccgaaagtctgctgggacatccctttactatttccgggcgtgtcgttcatggcgacgagctgggacgtaccattggcttcccgacggcgaacttaccgctgcgccgtcaggtctcaccggtaaaaggggtctatgcggtggaagtcaccgggcttggcgataagccgttacccggcgtagcgaacattggcactcgtccaacggtggctggcgtgcgtcaacaactggaagtgcatctgctggacgttgtaatggacctctacggtcgccatatagatgtaatactgcgtaaaaagatacgtaatgagcagcgatttgcgtcgcttgatgagctaaaagcgcaaatcgcacgcgatgagttaacggcccgcaagttttttgggctagccgggcaggtgtaaccctgacggtgtttatcaaaccgaaatacggaaccgagaatctgatgagtgactataaatcgaccctgaatttgccggaaacagggttcccgatgcgcggcgacctcgccaagcgtgaaccgggaatgctggcgcgttggaccgatgatgatctgtacggcatcattcgtgcggccaaaaaaggcaaaaaaaccttcattctgcatgatggccctccatatgcgaatggcagcattcatattggtcactcagttaacaagattctgaaagacattatcgtgaagtccaaaggactgtcgggatttgactcgccttacgtgccgggctgggactgtcacggtctgcctatcgagctgaaagtcgagcaggagttcggtaagccgggcgagaaattcaccgccgctgaattccgcgccaagtgccgcgaatatgccgccactcaggttgacggccagcgtaaagacttcattcgtctgggcgtgttgggcgactggtcgcatccgtacctgaccatggacttcaaaaccgaagccaacatcatccgcgcgctgggcagaattatcaaaaacggtcatctgcacaaaggcgctaagccggtgcactggtgtgttgactgtcgttccgcgctggcggaagcggaagttgaatattacgacaaaacgtcgccgtctatcgacgtggcgttccgtgccgtcgatcaggatgcggtgaaagcgaagtttggtttgccgggcgtgagcggccctgtgtcgctggttatctggaccaccacgccgtggacgctgccggctaaccgcgccatctccctggcgccggactttgattatgcgctggtgcagatcgacggtcaggcggtgattctggcgaaagatctggttgaaagcgtcatacagcgtattggcgcggctgaatacaccattctcggcaccgtcaaaggcgcggagctggaactgctgcgctttacccatccgtttatgggctttgacgtgccggcgatcctcggcgatcacgtcaccctggatgctggtaccggtgccgttcacaccgcacctggccatggcccggacgactatgtgattggtcagaaatacggtctggaaacggctaacccggttgggccggacggcgcttacctgccaggcacatatccaacgcttgacggtgttaacgtcttcaaagcgaacgatatcgttattgaactgctgaaagaaaaaggcgcgctactgcatgtcgaaaaaatgcagcacagctatccgtgctgttggcgtcacaaaacgccgatcattttccgcgcgaccccgcagtggttcgtcagcatggataaagaagggcttcgtcaacagtcgctgaaagagatcaaaggcgttcagtggatcccggactggggtcaggcgcgtattgaatcaatggtcgctaaccgtcctgactggtgtatctcccgtcagcgtacctggggcgtaccgatgtcgctgttcgtgcataaagaaacgcaggagctgctgccgattgagcgtactctggcggcgatggaagaggtggcgaaacgcgttgaagttgacggtatccaggcgtggtgggatctcgacccgaaagagatcctcggcgaagatgctgatcaatatgagaaagttccggatacgttggacgtttggtttgattccggttccaccagttactccgtggttgacgcccgtccggaattcgccggtcacgctgccgatatgtatctggaagggtctgaccagcatcgcggctggtttatgtcctccctgatgattagcgtggcgatgaaaggcaaagcgccataccgccaggtactgactcacggcttcaccgtcgatggtcaggggcgcaagatgtccaagtccatcggtaacaccgtgtcgccgcaggatgtgatgaataaactgggcgcggatatcctgcgtctgtgggtggcgtctactgactataccggcgaaatggcggtctctgacgaaatcctgaaacgtgctgctgacagctatcgtcgtatccgtaataccgcgcgcttcctgctggcgaacctcaatggcttcaatccggccaccgatatggtcaaaccggaagagatggtggtgctggacaggtgggcggtgggctgcgcgaaaacggcgcagcaagagattctgaaggcatacgaagcttacgacttccatgaagtggtacagcgcctgatgcgcttctgctccgttgaaatggggtcgttctacctcgacatcatcaaagaccgccagtacaccgcgaaggccgatagcgtcgcgcgtcgtagctgccagactgcgctgtatcatatcgcagaggcgctggttcgctggatggcgccgatcatgtccttcacggctgatgaaatctggggctacctgccgggcgagcgtgaaaaatatgtcttcaccggcgaatggtacgacgggttgtttggcctggaagagaatgaagaatttaatgacgcattctgggacgatgtccgctatatcaaggaccaggtcaacaaagagctggaaaatcagaaggccaatggcatcaaatcgaacctggaagcaaaagtgacgctgaaatatgctgacgatgctaacggtacgatcaagaagctgaaactgttgggcgaagaggtcagatttatcttcattacttcccagttcgtgatttctgagcaagcggggggtattgatgatgaaaatattcagtacaatgctggtaatacgacagttcaggcagtggtaacgcgtgccgagggtgataagtgtccgcgctgctggcactacactactgatgtcggcaaggtggcggaacatgcagatatctgcggacgctgtgtcagcaacatcgccggtaatggcgaacaacgtaaatttgcctgatgagtaaaccactctgttcaacaggactacgctggctatggctggtagtagtcgtgctgattatcgatttgggcagcaaatacctgatcctccagaatttcgctctgggggatacggtagggctgttcccgtcgcttaatctgcattatgcgcgtaactacggcgcggcttttagcttcctggcggatagcggcagctggcagcgctggttctttgccgggattgcgatagggatctgcgtaattcttttggtgatgatgtatcgctcgaaagcgacgcagaagctgaataacatcgcttatgcgctcattattggcggcgcgctgggtaatttgttcgatcgtctgtggcacggcttcgttgtcgatatgatcgatttttacgtcggcgactggcatttcgcgacgttcaaccttgccgatacggcaatttgtatcggtgctgcgctgatagtactggaaggctttttgccgaagccgacagcgaaagagcaggcataagcgtaaataccgggttgcgcttatccggttttgtaggcctgataagcgcagcgccatcaggcaaacgtggtgccggatggcggtgaaaacgccttatccggcctacggttttatcgttctttgtgcctccgggcaaaacacgtgagcaatttgcatgtctaaatccgtacagagcaacagcgcgatcctcgttcacttcaccctgaaactggatgatggctcaacggcggaatctacccgcaataacggcaagccagccctgttccgtcttggcgatacctcgctttccgaaggtctggagcagcagcttctggggttgaaagaaggggaaaagaaagcgttttcgctggagcctgacgccgcgtttggcgtccccagtccggacttgatccagtatttctcgcgccgtgagtttatggcggcgggcgaaccggaagtcggggcgattatgctttttaccgcaatggatggcagcgaaatgcctggcgtgattcgcgaaatcaacggcgactcgattaccgttgattttaaccatccgctggccgggcataccgttcactttgatattgaagtgctggaaatcgatccggcgctggaggcataaacatgcagatcctgttggccaacccacgcggtttttgcgccggggtagaccgcgctatcagcattgttgaaaatgcgctcgccatttacggcgcgccaatttacgttcggcacgaagtcgtgcataaccgctatgtagtggacagcctgcgccagcgcggagcgatctttatagagcaaattagcgaagtgccggatggcgccattctgatcttctccgctcatggggtttcccaggcggtgcgtaacgaggcgaaaagccgcgatcttaccgtttttgacgccacctgcccgctggtgacgaaagtccatatggaagtggcgcgcgccagccgtcgcggtgaagaatctattctcatcggccacgccgggcacccggaagtggaaggcaccatgggccagtacagcaatccggaaggggggatgtacctggtggagtcgccagaggacgtctggacgctgaatgtcaaaaatgaaggcaagctctccttcatgacgcaaaccacgctttccgtggacgatacgtccgatgtgattgatgcgctgcgtaaacgctttccgaaaatcgtcggcccgcgcaaagacgatatttgctatgccactactaatcgtcaggaagcggtgcgggcgctggctgagcaggctgacgtagtgctggtggttggctcgaaaaactcttctaactctaaccgattggcggaactggcccaacggatgggaagaaccgcgtttcttatcgacgatgcggcggatatccaggaggcgtgggtgaaagacgccgcctgtgtcggcgtcaccgctggcgcttccgcgccggatattctggtgcagaatgttattgcgcgtctgcgggagtttggcggcggcgaagctgtcacgcttgagggtcgcgaagaaaatattgttttcgaagtaccgaaagagctgcgtgtggatgttcgtgaagtcgaataagatttcacaattcagaaatctgcccgatgatgctacgctgaccagatcttaagaatttcttttgatattcaatgtgcgacaggaaaaataaggcgtagtcgtcatccggtgctaatgccccacctttttgctattcatctgaaaaaccagcacaatcgttgctggtttttgggttgtaatgcctacagggataagggaaatgggcaaaataaaatatagattgccaacgttactcgccatcggcttttggatggacgcggcaagcgctacggtgctggagctacccgcctgggagcgaaactataccgggactatcgcggggaaaccggtaaacgttaatatcacgcgatttggtaacacgctttatgggcattactgctatgaaccttgcaatcagcacaaggcagtgattgttctacgcggctcactccaggataaagaggtgcatcttgaagaacgcgtaaaggcgctttcgggttactggaatgcggaaatctccagcagtgagattaaaggcgaatggacgtccgcagataaaaaacgacattttcctgttgcccttatctattacaaacctaaaaactcccctgatattgtgctggtcacgaacacgaatgatgcagggggttacgacccttccaaagagattgattgcggcaatacgccggccatttcggcgataaaattataccgtgatggtaaactcatacagaccttagataccgcctcggtgggcacctgtagcccgtttatgcctcaatggggggatgtcaattttgatggctacccggatctatcgattgtaacagagttacttgctgggccggatgctccagtacaaacatggctctatgaccccgccaagcagcgttatgttgatgcgcccgcgtcttatcaggagatcacttcaccagagatcgatgctgaacataaacagattgtcagctattggcgcggcggttgctgcagccatggcgtcaatgtgtatcgctggaaaggaaaaacgattgaactgatcgatcgcggtgaaagctactttcagcctgtgataagtaaaggcaaaatgtataactgctacatgacaccttcctacgctgatgggcgtattatttatccgctagtacgtaaaaatggtcatttgacgccgcctcttagccttgatgggacgtgtcaatctttttggctaaccggtaatgttcgtaccgtgattcaggcagaaaaacccggcgctgagcccgaatcgcttgagattcagtggcaggaaaacaaagcatcgccagggcgtttttgcccattagttccgtttgtcgaaggtgataagctaagtccgcgtctggtgacggatgacgatgtgcctgatacctgtatcagtcgcgctgagtatgaagatataaaacaataggtcaggagagcgttaatgacagcatccctacacattattcttgataccgatccgggcattgatgacgcggctgcgattgccgctgcgctgttcgccccccagcttgatctgcaactaataaccaccgtcgcaggcaatgtttccgttgaaaaaacgacccgtaatgcgttgcagcttctgcatttctggaacagcgatatcccacttgcccagggggccgcgacgccgctgctgcgtccgttacgcgatgcggcatacgtccacggcgaatccggtatggaaggctatgattttgtcgaccatcagcgtcaaccgttggcgaagcctgcgtttatcgctatccgggatgtgttgatgaacgccccggagcccatgacattggtggcgattgggccattgaccaatattgcgttgctactgatgcactatccggagtgtgcgtgtaacattcgccgtctggtgttgatgggcggttccgcagggcgcggcaattttacgcctaatgctgaatttaacattgctgtcgatccggaggccgcggcgctggtgttccgcagcggtctggagattgtgatgtgtgggcttgatgtcacgaatcaggcaatgctctcgccagattttctgaataaactgcctgcgctgaatcgcaccggtaagatgttgcacagcctgttcaaccattatcgcagcggtagtatgcgcactggcgtccggatgcacgatctctgtgcgatcgcctggctggtgcgtccggagctttttaccctgcaatcctgttttgtggccgtagaaacgcagggggaatataccgcaggcacgacggtcgttgatattgaagggcgtctggggcagcccgccaacgcgcaggtggcgctggcgctggatgtggacggttttcgtcagtgggtggctgaggtgtttgcctatgtgccgtaattacatgttggcgccataatctcatactttgccgcgatagagtctctccggcctgcccactttcccgtagctgatctccgcttcgagaaagttatttttcacgccttgttccagatagcgtcgggcagtggttttactgctgcccagaatttgcgccagagtgtctgctgtatgtactgcctgcgggtcggcgaatatttgtcgtacccggttgaaggtgttttcatcaattccccgcagtccgctattcggttctgcggtttgttctttggcctggatattaaataaggcatcaacgtgcgtctggtttgcctgctcactggaacgtaacgaactgcggtaacgggtgaaccgctccagggtatgctgcaggcgctgataatgtaccggcttaatcagataatcgaatacgcccatgcgtaaggcatcgctgatggtatccatatgattgtcggcggtaatgaaaataattcgccccgtgtagttggtgctgatggtatgacgaattaaatcgatccctttgccatcgggtaaaaaattatccaatagaattaactgtggttgatagaggcgtatttgcttcttcgcactttccagcttgtctgcgataccgacgattgaaaactgaggaaaaagcttgatggtgtccaccaggatttccgctagcatcggttcgtcttcaacgatgagtgtcgtaatgctatccatgttattcttctctggtaaaagggatatagagggtaaaaatggtgccaaaagaattattgttatcgacgataatgtcgccattggcctgcttgacgtagctgtgcaccaaccataatccaattccgtgatcgccgttgttgtgggtggtcactccacgctcgaaaatatgctggcggatattttcgtcaataccacatccctgatcggcaacttcaataatgacttcattaccttcgctattgatcaggcactcaatctgtcgcgagccttcgcgattgagcagggtggcgttataggcgttgtccaataaattgccaacaatcgaaatccattcattatgcgagagcgatgacggcaggtgttcaacaaagcttgaaggatcgaaaatcagctccagccccagctcttttgcccgataatatttaccgattaatagccccgcaaggtggtggtcgcggaaattatgggaaataaaatcgagtactttttggtggctttccgactgctgctgaatcagcgccagcgcattatcgtagcgcttcaggaacagcagtccggcaatggtggaaataaggttgcgatgctcatgctgcacggcgcgcaggttatcggcgtattgccgcacctgacttaactgcaggttgagtgtattgatatcgtctttgttgcgaaagctaataacccagccctgaggctggttgtcaataatgaccgccatgcgactggcgatgactttcatttggttaaaagtgacgatctcatcttttttgtttttttgcggcgcatcgtaaaagaaggcctccggcaacacgatatggtggattgcatagccaatgagttcagactccggttggctcagattcagtaagcggcgagccgtttgattaatggcggtaatacggtgatgggagtcaatggcgatcaacccttcaaataccgactcaaataacacgctttgctgaattaatagttgtgaaagctgctgcggctccatgttaagcatctgctttttaatatgcagcgagaagcggcgggcgcagtacaacagcaccagcaacagtatcgccatcgggaacagcaacgagctgatttgtaagttaagccagctctccaactgttccagagtatagccgacggaaacaataccgatgactttaccggtactgtcctgaatcggggatttaccacgcaaggaagagcctaatgaacctttgcgcaccgatacgtagcttttagcattatacagcgcgtcgtcgctatcgccgccctccatatatttgccgatctcatccgggttgacgtgatacagtcgctgacctttttcgttgccaacggtaatgtaagtcgcgtccgaaaacgagcgcattgggtcaatcagcgctttgatgcgtgacaaatcatgcgcctctacggcttcaactaattctggcatagcggatatttgcattgcttgaataagcgcacgttggcccacctgataatgcaggcgctctttcgtgatatcggtcagataccaggtgattgccagcatcacgatggtggatgtaaacaggatcagtagaaatatccggttttgaaacgagcgtctggcaaaccagtgtgtaatttcccgtataaacatattggtatttagatatttaattacggtattttcttgcattcggcatcaccggaacctgaaccagttcatacttacttttctttcagaaaaaatttggatgaaaatgggatacgacatgcgtatcccatccactattacatcgccagcacgtatttcagcatcaccccggcggctatcgccgagccaatcaccccggccacgttcgggcccatcgcgtgcatcagcaggaagttctgcgcgtctgattccaggcccactttgttcgatacgcgtgccgccatcggcactgccgacaccccggctgaacctatcagcgggttgattttgttcttactgcacaggttcagcagcttcgccatcagcaccccggccgccgtcccgataccaaaggcaatcacccccagcagcagaatgcccagcgtctgcggctgcaggaacttatccgcgaccagcttcgcgcccaccgacagcccgaggaaaatggtcacgatattaatcagaccgttctgcaccgtgtcgctcagacgctccaccaccccgctttcacgcatcagattgccgaagcagaacatccccagcagcggcgcggcgtccggcagcagcagggccaccagcagtaacagcaccaccggaaagaggattttttcccgcttactcaccgtgcgcagctgcaccatgcggattttgcgctctttctcgctggtcagcgcgcgcataatcggcggctggattaacggcaccagcgccatatacgagtaggccgccaccgcaatggcccccagcagctccggtgccagcttgcccgacagataaatcgccgtcgggccgtccgcgccgccgataatgccgatggccgccgcctgcggcagggtgaaggcaatcaggccgaagtagttcagcgtcagcgcccccagtacggtggcgaagatgccgaactgtgccgccgcccccagcagcagggtgcgcggattggccagcagcgggccgaagtcggtcatcgcgccgacgcccataaagatgaccagcggcgcgacgccggagccaatcgccactttatagaacagcgccagcacccccggcgtgtagcccatgtccaccgccagattttccatctggttctggactgacggcagggccagcgccagcgcttccttgatggcgtgcacgtccggcgcgcagttgagcttcgcggcaatcaccgccagctgcccggcgtcgtgatgggccagcaggctctccagcgcggtcagcgccatgcccgcttccgggatgttggagagcaggccgccgaagcctatcggcagcagcagtaacggttcgaactttttcgctatcgccagccacagcaacagcaggctgaccagcagcatgatggcctggcccgcgccaaggtgcatcagccccatgccctgaagcagggcgttcagactttccatttcagttctccgttacgccagcgtcatcagggtgtcgcccacggagacggcgtccccggacttcaccgcgataccgcggacggtgccggcctgcgcggcgcggatttcggtttccatcttcatggcttccagaatcagcagcacgtcgccttcggccacgctctggccttcggtggcaatcaccttccagatgttgcccgccagcggcgcggtgaccggggtgccggcgcctgccggggcggcagcctgaaccggtgcggaagaggccgccggaacagccgtagtaagctggctgatatcgccgccgtcgctgaccctcaccacaaaggctttgccttccacttccacggtgtagataccggaggcggcaggcttctctgcttttgccaccggctgcgcggcttccgcctgcggcagtggctcaaacgccgccgggttatggcggttctcaaggaatttgaggccgatttgcgggaacagcgccacggtgagcacgtcgtcgatggcgtttcccgccagagtaatccccttctcctgcgcctggcgcctgacgtccgcttccagttcagccagctccggcttcagcaggtccgccgggcggcaggtcaccggagcgctcccttccagcacgcgggcctgtaacgcggcgttaaccggcaccggggtgtggccgtattcgcctttcagaatgccggcggtttccttcgcgatggttttgtagcgttcgccggtcaggacgttgagcaccgcctgggtgccgacaatctgcgaggtcggggtgaccagcgggataaagccgaggtcctcgcgcacgcgggggattttcgccagcacctggtccagcctgtccgccgcgttctgctgcttcagctggctttcgaggttggtcagcatcccgcccggtacctgcgccaccagaatacggctgtcgtagcctttcagctggccttcaaaggcatggtactttttgcgcacctcgcggaagtacgcggcgatattttccagcttcaggatatccagcccggtgtcgtgctcagtacctgccaacgtcgccaccagcgcctcggtggccgggtggccgtaggtggcgctcatggacgaaatcgccgtgtccacgccgtcaacatccgcctcgatagccttcagcagggccatctccgccatcccggtggtggcgtgacagtgcaggtgcaggcgcacctcaaaacgttttttgatttcgctcaccagctcaaaagcggccatcggcgtgagaatgccggacatatccttgatggcaatcgagtcaacgccggtctctaacaactgttcggtcaggtccagccaggtctgcagggtgtgcgccgggctggtggtgtaggagagcgtcccctgggcgtgcgcgccgtggctgcgcaccgcctgcagggcggctttcatattgcgcgggtcgttcatggcatcgaagacgcggaacacatccatgccgtttttcaccgcgcgttcaacgaagcgctccaccacatcatcggcgtagtggcggtagccgagcaggttctggccgcgcagcagcatctgcagcggggttttgggcatggcttttttgagttcgcgcaggcgcagccacgggtcttcgccgagaaaacgaatacaggcgtcaaaggtggcgccgccccagcactccagcgagccgtagcccacgtcgtcgagctgagcggcaatcggcagcatatcgtcaaggcgcaggcgggtggcgaacagagactggtgggcgtcacgcaggacgacgtcggtaatggcaatagtcatggatccctccgggaattaagcgttaaggcggtgatggtgaatggcggcggcaatcaccggctttaagcgggtgaagtcgtccacggcgggaacggcgcgcggtgcgggcgcggcgacgggttccgggaagaagcgagtaatcacggcagacataccgcgaatggcaaagatcagcaggaacagaaagctcagtacgaaccccatccctaaaaacatcagggtgaaaccttcacccagtaatacagcttcattcatgaatcattttccataatgagaggcacgacggtggccttgacgacaaccttcctggtgaatccggctaaggagtagagtggatttcccttggccacctctggctttggcctctacttttctccaggtcgtttgcggcaaagacaccgccgtgcgtttttttacaccatcatgctgaacacgatgctagcgataaccagcacaataccgccgcccagacgagaggaaatttgtgcatatgaaatgaggttcatacggttacaggcggagagcacttccagatcgccggagccgccgcggttggccatacaaagacccgcagtaatggatgattcaatcgggtagaagccaatcaaccagcccccgatagctgcgccaacgacagcgccgaccacaatgatcgcggcgataacgacgttcgcgaacgtcagggcatcgatgatctcttgcagatcggtgtagcaaacacccacacctaccatcagcacccacagcagttgtttggagaagaagtcagaaagacgtttcgccccggctttaatctccggtgagcaaagacctgatgcgttcagcgcagcaacaatcaggaccatccaggcgaagtagtgaatagagacgccgccgatgcttggcagaattttcttggcaacaacataggccagcaggaagcaggtggtggataacaccatgccaaccgccgtttcacgatgggtaatctgaccggccttttcatcatcttcggttttgaaggaagccttacgaaccaattcaccttcaccgctaagccaggtgtattttttgcctatcatatcgaggagggcggcgaaaataatggcgaagatattcgcaatggtcagaatagcaatagccgttgagtaatactcttcgcgagaacgtccggtaaccgagtgataaatttcagacagaggcacggcgcctgcgccgttaccaccgcccataatcggcagaacgtatagcatcatgatacggtcgaccgggataccgaagcacaaaccaatgacgataccgaaaagggacgcgccgacaatcccggcgaggatggttgggatatagcccagcagtgattttaatagcagcttacggtttaccgacaggatcgcgcctgtgatcaacactgcgataaacaggttaaggaagttgcttttatccattacgttgctgatcgcatcaatttctttctgcgtaaatatgccagcatagacaaaataagctgcaaccagaaatatcataaccggtgcgccgccaatatatttattgaagatcggtaaacgtttgccgatttcaccaaaaatggcccccataacaaacataagagcaaaaccaccgactaagtcagtcggtatagcattatagaaatgagacagtaataaagtaattaatgcaaaggcataaagcggtagcggcataccaaagattttgaatctgagtaaatcgctggccccctttttctccgtcgccgaagcctgggtcatgttggtcataaacattttcctgtgtattgatgggtaacaagacccgcgcatactaataaattcaatgaaccgtgagatgtgactatcttcactgaatggttgtgtttttaattaatttaattatttttattaactctggttaattaaggaaataaaaaccataaagcttataaaagcaagggggaaagtgtgatgtctattccagacgagtaatacaaacgctggcgaaatatgcaacgttatttgctgacggatgcagaatagagtgaatctaatatttaaacgcatttatttgcaaaaggatgtattgcgtcgcgagtcggtcgccatgtttctggagggcgtgggactcgccctggaagatgattgtgaaatcgcggtatgcgcatattggcagggtgagatagttggatgcggctcgctggccggaaacgtactgaaatgcatcgccgtttccccggttttacaaggggaagggctcagcctcaaactgctgactgagctgcttacattggcctacgagttaaaccgcagcgagcttttcctgttcactaagccgcaaaatcggttgctgttttctggcgcggggttttggcccattgcgcaggcaggtgagctggcggtgttaatggagaacagcagtgaacggttagcgcgcttttgtcgccaactggcgctttatcgtcaaccgggaaaaacgatcggcgccattgtcatgaacgccaatccgtttaccttgggccaccgttatctggtggagcaagcggctgcggcctgtgactggttgcatctgtttgtagtcaaagaagatgcttcatttttttcctataccgaccgttgggcgctgatcgaacaaggaatcgcgggcattgacaacgtcacgttgcattccggctccgcttatatgatctcgcgtgcgacgtttcccggctatttcctcaaagaaaaaggggttgtggacgactgccattgccagatcgatctgcaactcttccgtgaacatctggctccagcgctggggattacccatcgttttgtcggcagtgagccgttttgtcctctgacctgtgcctataaccagcggatgcacgacattttacacgatccgaagcgcagcggcccggttattgaggtcgtcgagctggcgcgggtggagaaaaacggcacggctatttccgcctctcgcgtcagaaaactgtatagcgaacgtaattggccggcaataagcgcgctggtgcctgctggcaccctggcatatctgcagcggcatgccgccagacacactgaaaccatatgacgtaacaccgttaacaaggaacataactaatgaaaatcattaaagatgccctggcaggcacgctggaatccagcgatgtgatgatcaggattggtccatccagcgagccaggaattcggctggagctagagagtctggtgaagcagcagtttggcgcggcgattgagcaggtggttcgggaaacgctggcgaagctgggcgttgaacgcgcgctggttagcgtcgatgacaaaggcgcgctggagtgtattttacgcgcccgagtgcaggcggcggcgttacgcgctgcagaacaaacggaaattcaatggagtgcgttatgagacctcgtcgcagtatgttgtttatccccggcgcaaatgcggccatgttgagcacctcgtttgtctatggtgcggacgcggtgatgttcgacttagaagacgccgtagcattacgtgagaaagataccgcccgtcttttagtccatcacgcgcttcaacatccgttctatcaggatgttgaaaaagtggtgcgcattaatccactgaacacgccattcggtctggccgatcttgaggccgtcgtgcgtggtggcgcggatatcgtgcgtctgccgaaaaccgacagcaaaaacgatgtgctggagctggaagcgcaggttgaacggatcgaacgtgaatgtggacgtgaagtcggcagtaccaggctgatggcggcgatcgaatcagcgaaaggcgtggtcaatgccgtcgacatcgccacctccagcccgcgcatggtggcaattgcgctggcggcatttgattacgtgatggatatgggcaccagccggggcgatggcaccgagctgttctacgcccgctgcgcagtgctgcatgcggcgcgcgttgcgggtattgccgcctatgatgtcgtttggtcggatatcaataatgaagaaggcttcctgaaggaagtgcagttggcgaaagggcttggttttaacggtaagtccttagtgaatccacgtcagattgagctgttacatcaggcttattctccgacgcgtaaagaagttgagcatgcgcacgaggtgattgccgccgctgaagaggctgagtctcgcggtctgggcgtcgtttcactcaacggcaaaatgattgacggcccgattatcgaccacgcgcgcaaagtggtggcgctgtcggcttccggtattcgtgattaaggaaggaaccatgaaagagactgtaactatgctcaatcagcaatatgtcgtaccggaaggattacaaccctaccagggggtaacagtgaatagcccgtggcttgccagtgaaacggaaaagcgtcggcgtaaaatttgtgactcgcttgaagaggctatccgtcgttccgggcttaaaaatggcatgacgatatccttccaccatgcgtttcgtggtggcgacaaagttgtcaatatggtgatggcgaaactggcggaaatgggattccgcgatctgacgcttgcctccagctcgttaatcgatgcccactggccgcttatcgaacacattaaaaatggcgtggtgcggcagatttacacctctgggctgcgcggcaagttaggggaagagatctccgctggcctgatggaaaacccggtacagatccactctcacggcggccgcgtaaaactgattcagagcggtgagctgaatattgatgtcgctttcctcggcgtgccgtgctgcgacgaatttggtaatgcgaacggttttagcggcaagtcacgctgcggctctttggggtatgcgcaggttgatgcgcagtacgctaaatgtgtggtgctcctgactgaagagtgggtcgagttccccaattatccggccagtatcgcgcaggatcaggttgatttgatcgtacaggtggacgaagtaggggatccggaaaaaatcactgcgggcgcgattcgtctgtccagcaacccgcgtgaactgttgatcgcccggcaggcggccaatgtgatcgaacactcgggttatttttgtgacggtttctcgctgcaaaccggcaccggtggcgcttctctggcggtcacccgtttcctggaagacaaaatgcgtcgccacaacattacggcgagttttggcctgggcgggatcaccggcaccatggtggatctgcatgagaaagggttgatcaaagcgctgctggatacgcaatcattcgatggcgatgcagcccgttcgctggcgcagaacccgcatcatattgaaatttcaaccaatcaatacgcgaaccccggctctaaaggcgcggcatgcgaacgcctgaatgtggtgatgctgagcgcgctggaaattgacgtgaatttcaacgttaacgtgatgaccggttcaaacggcgtactgtgtggcgcatcgggcggccatagcgatacggcagcaggggccgatctcaccattattaccgcaccgctggtgcgcgggcgtattccttgcgtggtagaaaaagtgctgactaccgtcacgctaggggcaagcgttgatgtgctggttaccgaccatggtattgcggtgaaccctgcgcgtcaggatctgcttgataacctgcgtgctgcgggcgtggcgctgatgaccatcgaacaactgcaacagcgcgccgagcaactgaccggtaaaccgcagccgattgagtttaccgatcgggtggtggctgtggtgcgttatcgcgacggttcagtgattgacgtgattcgccaggttaaaggctgatgaagggcacagacctgctgtaccagggccaggcagttacgctggaggagatgctacaagcgcgcgataaacgtgccgccaggcagcgtcaggcgttgaactgctatcggctaccgttgatttccctcacgctggttgcaccgggcgccgttaaaaactcagcggtctggcggcgtgtcgccgattacgcaattgccgaaatactggcgctttgcgaacagaaggagtgggtcaacgtctgggaaatgcaggtaaatgaacgcagcggcccggaatggatggcagcggtctgtgcgccggcaatggcgttgaaacagcacatgtcgacactagagatgagccatccgttagggcggctttgggacatcgacattattgatagcgacggtaagtcgctatcacgccgtgaactcgggcatcctgcccggccatgtttgatatgccagcaggatgctcatctctgtgcccggggcaagcatcacacccttgaccttttgttggatgaaattgcacgaaggattgaatgctatgaacgtgagcgttgtgactgaacggcgtacgccagcgtactcatcgctggcggctggcgaacttaatgggttggttgcaagagcgctgctgacggaagccaggctgacaccaaaacccggtctggtcgatattcgtaattcgggagcgcatagggatatggatctggcggcatttgaacgtagcactaccgccattgctccgtggatggaaaagttttttatcatgggcaacaacacggcggcgctggcggcagaaaatgtcctggtgatgctgcgtccgctggggatggcctgtgagaacgatatgctacaggcgaccaatggtgtgaatacccatcgcggggcgattttcgcttttggcctgctgagcgcagcgattggccgacttctcgcgcggggagaaccgttggagcaaaatcgtatctgcgaccaggttgctcgcctgagtcggaatattgttgcccacgagctctcagcaagaaaagcgggaaaactgacaaagagtgaaacccatttccagtgttatggcctgtcgggcgcgcggggagaagcggaaagcggttttcgaaccgtcagaacgcaggctttgccggtgtttaaccgggtcgtgcaggagcatgacgatacccatcttgccctgctgcaaacattgttgcatctgatggcgtggaatgatgataccaatctggtgtcacggggaggcctggaagggctttactacgtgcagcagcaggcacaaaaattgttgtggcaagggggcgtattggttgaggggggcattgaagcgatgcagttcctcgatgatgaactcatcctgcgtaacttaagccctggcggtagcgcggatttactggcagtgacctggtttttaagtcattttcctgccggttccctctatcctgagtaagtttctcttctttcattctctccagcaatgattcatcctgtgggatgaatcatgtcttttactgatatcgctccctgtttatcattaatttctaattatcggcgattttagatggcggcctccgggcgcgctggttactctgaaaacggtttacgcaatttttacaaaagagaatagctatgcatgaagcacaaatccgcgtcgccattgccggcgccggtggccgcatgggacggcagttaatccaggccgccatggcgatggaaggtgttcagctgggtgccgcgctggagcgcgaaggctcttccttgctgggcagcgatgctggcgaactggcgggggcgggaaagtccggcgtgatcgttcaaagcagccttgaggcggtaaaagatgattttgacgttttcatcgattttacccgtccggaaggcacgttgacgcatctggcgttttgccgccagcatggtaaagggatggtgattggtactaccggctttgacgacgccggtaaacaggccattcgtgaggcgtcgcaagagattgcgatcgttttcgccgcaaactttagcgtcggcgttaacgtcatgctcaagctgctggagaaagccgcgaaggtaatgggcgactatagcgatattgaaattattgaagcgcaccaccgccataaagtggatgcaccgtcggggacagcgctggcaatgggcgaggcaatcgccggggcgctggataaagatctgaaggactgcgcggtctactcgcgtgaaggttataccggcgagcgcgtaccgggaacgattggctttgcaaccgttcgggcgggcgacatcgtcggcgaacataccgcgatgtttgccgatattggcgagcgcgtagagattacgcataaagcttccagccgcatgacgtttgcaaatggcgcgttgcgatcggcgttatggctaaaaacgaagaaaaatgggctatttgacatgcgggatgtgctggggctggatgtattatagcgactaaataccttcgtgatgtggttgtggtaatcaagattaattgattacaaagggcaatatattattgcccttttgtttttgcccctcggttattcggtcagataaataacgcctttcaccattcatgtttcgacagtttcttctcccacgacatgttctgccgcagtggcttaccgtatgcaaaaggcacctcgaccagactgataagactgatatccattggggggttagtgctgttccacgggatcgttttatctcttttgcttcaataagttagcttttttatgctgtagtgaggctgtttgtggtccaatcgtatgcgcctgtcttaaagaaaaagaagttagatattaatatcgaaattggagttatcattatatagtcttaatttgctgttttttgttgattttatgatgcatttgatttgttttttatatttttaaggtattgatttttaaaatgtttttgttgttaatttgatttattttgaatttttatgcatttaatgactattaaatgaatttttatcgttgttttttgttgttttaatgtgaaatttgaccatttggtccactttttatcatggcagccagttttttgcgaactcaaggaagcgcaagcgttttctatcgtcacttagttgatctttttgcctattaaacagaataacttccttataatgtgcaaaataacataaaaaatacccgctttaagttgacttttatccggcttaacttcagaatgccgccgtttgccagaaatccacgggtaagcaaatttgcattgcttcatactgactgaatgaattgatatgcaaataaagtgagtgaatattctctggagggtgttttgattaagtcagcgctattggttctggaagacggaacccagtttcacggtcgggccataggggcaacaggttcggcggttggggaagtcgttttcaatacttcaatgaccggttatcaagaaatcctcactgatccttcctattcccgccaaatcgtcactcttacttatccccatattggtaatgtcggcaccaatgaagccgatgaagaatcttctcaggttcatgcgcaaggtttagtgattcgcgatctgccgttgattgccagcaacttccgtaacaccgaagacctctcttcttacctgaaacgccataacatcgtggcgattgccgatatcgatacccgcaagctgacccgactgctgcgtgagaaaggcgcacagaacggctgcatcattgcaggcgatagcccggatgcgaagctggcgctggaaaaagcgaaagcatttcctggactgaacggtatggatctggcgaaagaagtgaccacggcggaaacttaccgctggacgcagggtagctggacgctgaaagacggtttaccggaagcgaaatctgaggatgacctgccgttccacgtggtggcctacgattttggcgccaagcgcaacattctacgtatgctggtggatcgcggctgccgcctgacggtggtgccagcgcaaacctctgctgaagaggtgctgaaaatgaatccggacggcatcttcctgtcgaacggccctggcgacccggcgccgtgcgactacgccatcgaggcgattaagaaattcctccagaccgacattcctgtgttcggcatctgcctcggccatcaactgctggcgctggcgagcggtgcgaagaccgttaagatgaagttcggccatcacggcggcaaccatccggtaaaagatatggacagaaacgtggtgatgatcaccgcgcagaaccacggatttgcggtggatgaagactcgctgcccgccaacctgcgcgtgacccacaagtcgctgttcgacggcaccctgcagggcattcaccgtaccgacaaaccggcgttcagcttccagggacacccggaggcgagcccgggcccgcacgatgcggcgccgctgttcgaccactttatcgaattgattaagcactaccgttcttcagcaaaataatcaggagccaacaaaatgccaaaacgtacagatataaaaagcatcctgattctgggcgcgggcccgattgttatcggtcaggcgtgtgagtttgactactccggcgctcaggcgtgtaaagcgctgcgcgaagaaggctaccgcgttattctggtgaactctaacccggccaccatcatgaccgacccggaaatggccgatgccacctacatcgagccgattcactgggaagtggtgcgcaaaatcatcgaaaaagagcgtccggatgcggtgctgccgaccatgggcggccagaccgcgctgaactgcgcgctggagttggagcggcagggcgtgctcgaagagttcggcgtcaccatgattggcgccaccgccgacgccattgataaagccgaagaccgtcgtcgcttcgatatcgccatgaagaaaattggtctcgacaccgcgcgttccggtatcgcgcacaccatggaagaagcgctggcggttgccgctgacgtgggcttcccgtgcatcatccggcctagctttaccatgggcggcaccggcggcggtatcgcttacaaccgtgaagagttcgaagaaatctgcgaacgcggtctggatctctcgccaaccaacgaattgctgattgatgaatcgctgatcggctggaaagagtacgagatggaagtggtgcgtgataaaaacgacaactgcatcatcgtctgctctatcgaaaatttcgatgcgatgggtatccatactggggactcgatcaccgtggcgcccgcccagactctgaccgacaaagaatatcaaatcatgcgtaacgcctcgatggcggtactgcgtgaaatcggcgtcgaaaccggcggttctaacgtccagttcgcagtgaacccgaaaaacggtcgtctgatcgttatcgaaatgaacccgcgcgtctcccgctcctcggcgctggcgtcgaaagccaccggtttcccgattgccaaagtggccgccaaactggcggtaggttacacccttgacgaactgatgaacgacatcaccggcgggcgtactccggcctccttcgagccgtccatcgactacgttgtgaccaaaattccgcgctttaacttcgagaaattcgccggtgccaacgaccgtctgaccacccagatgaaatcggtcggagaagtgatggcgattggccgcacgcagcaggaatccctgcaaaaagcgctgcgcggcctggaagtcggcgccaccggcttcgacccgaaagtcagcctcgacgacccggaagcgctgaccaaaatccgccgcgagctgaaagatgcgggcgcagatcgtatctggtatatcgccgatgccttccgcgcaggcctctccgtcgacggcgtgttcaacctgaccaacatcgaccgctggttcctggtgcaaattgaagagctggtgcgtctggaagagaaagtaactgaagtcgggattactggcctcaacgccgacttcctgcgtcagctcaagcgtaaaggttttgccgatgcgcgtctggcaaaattggcgggcgtgcgcgagggggaaatccgtaagctgcgcgaccagtatgacctgcacccggtctacaagcgtgtggatacctgcgcggcggaattcgccaccgacaccgcctatatgtactccacttatgaagatgagtgcgaagcgaacccgtccgttgaccgcgataaaatcatggtcctcggcggcggcccgaaccgtatcggccagggcattgagtttgactactgctgcgtacacgcctcgctggcgctgcgcgaagacggttacgagaccatcatggtcaactgtaacccggaaaccgtctctaccgactacgacacttccgaccgcctgtacttcgagccggtgacgctggaagacgtgctggaaatcgtgcgtatcgagaagccgaaaggcgttatcgtgcagtacggcggccagaccccgctaaagctggcgcgcgcgctggaagcggcaggcgtgccggttatcggcaccagcccggacgccatcgaccgcgcggaagaccgcgagcgcttccagcacgcggttgaccgtctgaagctgaagcaaccggccaacgccaccgtcaccgccattgaacaggctgtcgaaaaagcgaaagagatcggctacccgctggtggtgcgtccttcttacgtgctgggcggccgggcgatggaaattgtctatgacgaagccgatctgcgtcgctacttccagacggcggtcagcgtctctaacgatgcgccggtgctgctggatcgcttccttgatgacgcggttgaagtggacgtggacgctatctgcgacggcgaaatggtgctgattggcggtatcatggagcacatcgagcaggcgggcgtacactccggcgactccgcctgttctctgccggcctacacgctaagccaggaaattcaggatgtgatgcgccagcaggtgcagaagctggccttcgagttgcaggtgcgcggcctgatgaacgtgcagtttgcggtgaaagacaacgaagtctacctgattgaagtcaacccgcgtgcggcgcgtactgtgccgttcgtctccaaagccaccggcgtgccgctggcgaaagtggcggcgcgcgtgatggccggcaaatcgctgaccgagcagggcgtgactcaagaaattatcccgccgtactactcggtgaaagaagtggtactgccgttcaacaaattcccgggcgttgacccgctgttagggccagaaatgcgctccaccggggaagtgatgggcgtgggccgtaccttcgcggaagcgttcgccaaggcacagctgggcagtaactccactatgaagaaacagggccgtgcgttgctctcggttcgcgaaggcgacaaagagcgcgtggtggacctggccgctaagctgctgaaacaaggcttcgagctggatgccacccacggtacggcgattgtgctgggcgaagccggtatcaacccgcgtctggtgaacaaggtgcacgaaggtcgtccgcacattcaggaccgcatcaagaatggcgaatatacctacatcatcaacaccaccgcaggccgccgggcgattgaagactcaagggtgattcgccgcagcgcgttgcagtataaggtgcattatgacaccacgctgaacggcggttttgccacgacgatggcgctcaatgccgatgccaccgagaaggtaacctcggtgcaggaaatgcacgcgcagatcaaaaagtcgtaaaccaagggggcggcggatattgctctaaccgaacctgtaatataatgttgaaagggtttctgtaaagaaaccctttttttatcttgcgtaaggtcattcctggagaagtccgtttccgtaaccacattttcaatgtaataagcacgatattgctcacactaatcaatatttaagtcgcatactatctttcatatccacaattttaatatggcttagtttttattagtttggacaggccgtagccagatttttaatttgtgaaatggtgtgcttatgtgtgaaaaatatgttgaaagaccgctttatttgttaattgctgactggatgatggcagagaaccgatggatcactgccagggagatttcccgtcaatttgatattgaacattgcaaagcaattaatacgctctcctatattctgtcagaagtgggggaaattgtttgtgaagtgaagatgatccctaaccaaattgcaggacgaggctgccagtgccagcgtctggtgaaagtcgtgagtatcgactctcaactctatcgccgattgaatcataatttgcaggaaagaaaagtgagcgtggcgaaagcgccgcggctgtctgccgttccccccacagagctaaaccgtgagcagaaatggcagatgatgctctccaagagtatgcgtcgctaattgtctgtttaacctgctggcggggtaaacggtaattgacgcgtaggccggataagcgtgagcgcatccggcatcaattactgtgctgattttggcttcacgtccgtcgtgcctttcaggcgcggtcggttttcttcgacctgcgttaacggcttcgtttcagataaccccgttcgacaacggatcgcaagatcctgatattctttggtattgaggcgtttccagtgcagctcctggtccgtaacctggcgtagtacgcgcgccggtgatcccaccagcagttgccttgcctcaccctgaaatccggctttgacaaaactcatggcggcgacaatgctctcttcgccaatcactgcgccgtccataatgacgctattcatgccgaccagggcatcccgtcccaccacgcagccatgtagaatagcgccgtggccgatatggccgttttcatgcacgatggtatcggtatcgcagtagccatgcataatgcagccatcctgcagattagagcctgcctccaggatcaggcgaccataatccccacgcaatgacgcgagtgggccaatataaacaccggcgcccacgatgacatcgccaatcagcacggcgctgggatggacaaacgcgtccggatgcaccaccgggatcagtccttcaaaggcgtaatagctcatggttgtacctcggtttttttttgtcggatggcggcgtaaataccttatccggcctacggttgtgcatgtgttgtaggccggataagcaaagcgccatccggcatagtcacattaacgacctttccacaccggagcgcgtttttcggcaaatgcctgcggtccttcgagcgcatcttctgaatgcagtaccgacggataatgtttcagcacgccgctgcggatgtagcggtagccttcttcaaccggcatttcactggtcgcgcgataaatctctttcagcgccgcgatagccagcggagcgctattgaccagttgttgcgccagttcgcgcgcgctctccatcagttcgctctggctgacaacgcggttcacgatcccccaacgcagcgcttcttcggcgctcattcgtctgccggtcattaccatttcgttgacgatagccggtggcagcagcttaggcagacgcaatacgccgccgctgtcaggcacgatgccgagcttggcttccggcagcgcgaagctggcgttttcggcgcagacaataaagtctgccgccagcgccagctcaaaaccgccaccaaatgcgtagccgttcaccgcggcgataaccggcttatcgaggtcaaatatttcggttaaaccggcaaagccgccgggaccaaaatcggcatccggcgcttcaccttccgctgccgcttttaagtcccagcccgcagaaaagaatttctccccgccgccggtaatgattgctacgcgtaattccgggtcgtcacggaaattaagaaaagcttcacccatcgcaaaactggttttcgcatcaatggcattcgctttaggtcggtcgagggtaatttccaggatcgggccgttacgggtcagatgtaatgactcactcatagttcatctccagataaatagtttcccggcgggagggattcctgccggaaggtttatttcagattttttttgattatttttcctgaacagttgcgtggcaggtcagttctgatctccataaaagagggaactttgaatttcgccatattgttttcgcagaagctgaaaaactcggcctcgcttaatgtttcaccttcattaaggacgataaacgctttaatggcttcatcacggatcgcgtctttaataccgaccaccacaatgtcctgaattttcggatgcgcagaaataatattttccagctcgacgcaggagacattttccccgccgcgtttaatcatgttgcagcgtctgtcgacaaaatagaaatagccatcctcatcctggtaacccgaatcaccggtatgtaaccagccctctggttccagcgccctggcggttgcctccggctgcatgtaatactctttgaagatagtcttgccggggatgcctttaatacagatttcgccaatttctccggcgggcagcgggcgattttgatcgtcgcgaatttcagcttcatagctaaagcccacgcgaccaatggaaggccagcgtcgtttgtctccgggacggtcgccaataattccgacaatggtttcagtcataccataagaggtcagcagcctgacgccaaagcgttcggtaaaggcgtctttttcctgcgcggataaattgagatagaacatcacttcgcgcagatgatgctgcctgtccgttggcgtggcgggctggaccatcagcgtgcggatcatcatcgggatgcactcggtcaccgtcgcctgatatttacgtacctgatcccagaaggccctggcgctgtacttctccaggagcacaaaggtgctgccggcggaaaaggctggcattgcggcggtacactggcagtcgatatgaaaagcgggcatcaccgtcatgtacacgtcatcatcgcgcagggcgatttgccaggcagagtaatagcctgcaaagcgcaggttatagtgggtaatcaccaccccttttggacgcgaggtggtaccggaggtaaacagaatttccgccgtatcgtcagtggataacgcgggcgtatagcacagcgtggccgactggcgtgcttgtagttgggaaaagtggctcacgccgtcgtcagccggaagctgctcgccaatcagacagatatgattaagcggagtgctattgtcctggcgtatttcacggtacataggataaaactgggcgctggtaaccagcagactcacctggctgttttgcaggatccaggcgctttcttcgcccagtaagcgggcattaatcggcaccataatggcgccgatttttgccagtccaaaccagcaaaagatgaattccggacagttatccagatgcagcgcgaccctatcacccttgcggatccctaagtaataaaaaaggttcgccgtgcggttaatctcttcattgagcgaagcatagctaaactgccgaacgattccctcacaggattcgaaaattaacgccgttttatctccgtacatcccggccaggtcgtcccacatctgacgtaagttttgtccgccaacgatatccatattgctttatccactgaaatcaggcgtgagcgctaaccggaaaaccgagtagcgcatcgcgtttaatcctcaactttggccaggcctttgccgaccagttccttaatatctgcttcgctataaccaatgtttttcagaatggcggcggtatccatgccgtgtgatggcatgccacgccagattttccccgggttgtttttaaatttcggcatgatgttcggccctttacaggtgcgaccgtccattgtttgccactgagtaatcgattcgcgggcaacgtactgcgggttaccttccagttccggaatggtgagcaccttcgcacaggcgatattcagctcagcaaaacgcgcctgaacgtcggcgatggtatgtgctgccagccaggcgtccagtttctcttcgacgagcgggccgtaagggcattccacgcgatggatgagctgcgtgccttccggaacttccggcgtaccgagaatgtgcgccaggccaatatctttaaaacactcgttgatttgcgtgatgccgaccaactccatgacgatgtaaccatcggcgcatttatacaggccgcaaccggcgtagtaggggtctttccctttcgtcatacgtggacagatttcgccgccgttgaagtagtccatcatgaaatactgacccatgcgcagcatcacttcgtacatggcgatatcgatgctttcacctttacccgtttcgcgtactttgtgcagggctgccagcgcggctgtcgtcgcggtcatcccggagaagtaatcggcggtatacgggaaggctggcatcggttggtcaacgtcgccgttttggatcagataaccactgaatgcctgcgcgatggtgttatacgccggaagattggtgtactcctcggtaccatactggccgaagccggaaaggtgggcaatgaccagtttcgggttatgttcccacagcacttcatcagtaataccacggcgggcaaaggccgggcctttactggcttcaatgaaaatatcggtggtttccatcagtttcagaaacgcttcccgaccttcatctttgaaaatattcagcgacagggcgtgcaggttgcggcgtgagagctgcgggtagttaggctgtacgcggatggtatcggcccatgcgacgttttcaatccagataacctcggcgccccattcggcgaacatctgtccggcgaacggaccggcgatttcgatccctgaaaaaacaacgcgtaccccagcaagaggaccaaaggttggcattggtaaatgattcatcgtttttctcctggcattttttgcggtatgtaggccggataagcacagcgccatccggcatgattgcctgatggcgacgccccgcgtcttatcaggcctacaagggatcgattagcggtattgcttgagtaccgcacgacccaacgtcaggatctgcatttcgtcagaaccaccagaaacacggtcaacgcgcaggtcacgccagaaacgcgtgatgcggtggttgcccgcgataccaacacctcccagtacctgcatggcggtgtctaccacttcaaacgcggcgttggcgcagaagtatttgcacatggccgcgtcgccggaggtaatagtgccgttatctgctttccacgcggcttccagcagcatatttttcatggagttcagtttgatcgccatatgcgcaaacttctcctgaatcagctggaaacggccaatagcttcaccaaactgcacgcgctgattagcgtaacgcgcagcgtcttcaaaagtgcacattgcggtaccgtagttggtcagcgcgacgaggaagcgttcatggtcaaactcttctttcacgcggttgaagccgttaccttcccgaccgaacatgtctttctcgtccagttcaacgtcgtcaaaggtgatttcacagcagctatccatgcgcagaccgagtttctccagtttgttgaccttgatacccgctttgctcatgtccacaaaccactcggtgtaaaccggtttatccggcgatgcaccgtctctcgccatgaccacgatgtacggggtataggcgctactggtgataaagcacttactgccattgagataaaccttaccatttttgcgtgtataagtggttttcagactaccaacatccgatcccgctcccggttcggtgatagcagagttccacatctgcttaccggtgccccggaacgccatgattttatcaatttgctcctgagtcccttcacgcaggaaagtgttaaaacctcccggcaattggtacaacacgtaagttggcgcgccaagacgtcccagttccatccagacggcggcgacggtaacaaaacccgcttccagaccgccgtgttcttccgggatcagcaggctatcaatacccatatccgccagcgcttttacaaaacgctcagggtagacgctgtcacgatcgcactcggcaaaataagcttcccagttctcactggccatcagttcgcgaataccggcgacaaacagctcctgttcgtcatttaagttgaaatccatctttcagcctcttgatcaattgggttaataagaattacttgtctttccagtgcactttggcgtctttaataaaggacagcgtcaccataatgttgacgaagaacagcgggcatcctccggcgataatcgcggtctgaatcggcttcaacccacccagcgccagcagaacgataccgatgatgccgaccagcaccgaccagccgatgcgtactaacagaggcggctcttcaccatcgcgaacttcgcgacaggtcgacatcgccagggtgtaagagcaggcgttaatcagcgtgacggtggcaataaagcagaggatgaagaagccccacatggtggcggtgctgagcggcaaggctgcccaggtttcgataatggcgcgcgccacgccgtgttgctcaatcagttgcgggatgttgaggatgtttttatccatcagcagcagcgtgttactgccaaggactgtccacaggatccaggtagacgcggtcagacccatcaccatcccgaagcacagttcacgtacggtacgaccacgggaaatacgggccaggaagatactcatctggatggcgtaaataacccaccacgcccagtagaaaacggtccagccctgtgggaagccgcctttaccgatggcgtcggtatagaacagcatccgtggcaggtgcattaacagcatcccgacggagtcggtgaagtagttcatgatgaagctggcgccgctgacgataaacacccagccgagcatcaggaagctcaggtagctacgcacatcgctggcgattctgacccctttttgcaggccgcaggccacgcaaatcgcgttcagaatgatccagcaggtaatgatgatggcatccaattgcagcgtatgcggaataccgaacagccattgcatacactcggtgaccagcggggtagccagaccgaggctggtgcccatcgcgaagatcagcgccaccaggtagaagttatcgacgatggtactgaacaaccctttcgcatgcttttcaccgacgagcggtaccagcgtggagctggggcggatgacatccatcttgcgtacaaagaagaagtaggcgaaggccacggaaaggaagctataggttgcccacggtagcggcccccagtggaacaggctgtacgccaggcctatctctttcgcgcccgtggaattgggttccaggccgaacggcggggtggagatatagtagtagatctcaatagagccccagaacagaaccgcagcggatgtacaggaggcgaacatcatgaaaatccagctggcggtgctaaactccggtttttcgtcacctaatctctttttggcataggggccaaaaaccagccagaaccagctgaagagcatgacgaccatataccattcaaatgcccaaccccagacgttggtgacataactgaataccgcattaataacgacgttagcggcatcaagatctctgactgttagccagcaaagtatcccgacaattattaatagcggaaaaaaaaccttcggttcaattcccgattttctcttttcatttttcataagtgaattccagtgtgaaaacgaaatttatttagcgtgccagttcatgaacgtttgtttatttattattaatgatttgttgataagtttttaacctctgggacgcctcaatgagtaactcataatgggtattcatttcgggtgattctgttatctgtgtcacacttttttgcgttgattattttgtgtttaaattttgattttttctttatttatcaatctgttggttgtggttttttaacttttttaagtatctggcgttcaatattgttgagccagcaaacaatattgaaaattttcatatttggcatatttctttcaatattggtgaggtgcgtaacactattgaaagttacgaatatcaatgtgtgacattttcaatattggtgattaaggttttatttccgaattaaagagcgtgatatctgtatttaacaccgccgatataaatacgtttccttcatgatttctggagatgcaatgaagataattacttgctacaaatgcgtacctgatgagcaggatattgcgattaataatgctgacggaacactcgatttcagcaaagcggatagcaaaatcagccaatatgatctgaatgcaattgaagctgcttgccagttaaaacagcagttgggagacgctcaggttgtcgccatgagcgttggcggcaaagcgctgactaatgcaaaagggcgcaaagatgtcctctctcgtggccctgatgaactgattgtggtcattgacgatcaatttgagcaggcgctgccgcaacacaccgctaccgcgctggccgccgcggcgcaaaaatcaggtttcgatctacttatctgcggcgacggttcttccgatctttatgctcagcaggttggtttgctggtgggcgaagcgctgaacattccggcgattaacggcgtgagtaaaatcctctctcttaccgacagcacattgacggtagaacgcgaactggaagatgaagttgaaacgctgagcatcccgctcccggcggtgatcgcggtttccaccgacattaacaccccacaaatcccttcgatgaaagccattcttggcgcggcgaaaaaaccggttcaggtctggtcgcctgcggatatcgggctgaacagcgtacccgcgtattccacacaacaggttgccgcaccgaagcagcgcgagcgtcagcgtgtggtgattgaaggtgacggtgaagaacaaatcgccgcgtttgtcgagaatctgcgcaaaatcatttaattatcaggggatgttatgaacaaattttccagtgtctgggtattcagcgataccccttctcgtctgcccgaactgatgagtggtgcgcaggctgtaggtgaaaaagttaacgcgttcgtactgaacgaagcggacagcgcgacagcatgtcatttgggcgcggatcatgtctggctgctcagcggcaaaccagaagatcgcatgatcgaagactacgctgctgcgatggctgagactattcgtcagcatagcgagggcggcgcggtgctgctgccgaatacgcgtcggggcaagctgttggcggcaaaactgggctatcgcttgtcggctgcggtttccaacgacgccagcgacgtctccctgcaggatggaaaagcggcggtcaaacatatggtctacggcggtctggcgataggggcagagaccatcgcttcgccgtttgccgtgatcacactcagcagcggaacgtttgacgcacaacagccggatgcttctcgcagcggcgagatgcacaccgtgcagtggcaggctccggccactgccgtgacccgcaccgcaacccaggcgcgtcagagcaacagcgttgacctcgacaaagcgcgtctggtggtcagcgtgggacgcggcatcggcagcaaagagaatatctcgctggccgaagcgctgtgccagaccatcggcgccgagctggcctgttcccgcccggtggcggaaaacgagaagtggatggagcacgagcgctacgtcggtatctccaacctgatgctcaaacctgaactgtatctggcggtggggatctccgggcagatccaacacatggtcggcgccaacggcgcgcagacgattttcgccatcaacaaagataaaaacgcgccaatcttccagtatgcggattttggcatcgttggcgatgcgctgaagatcctgcctgcgctgacggctgccttagcgcgataaaccatttcgggcaggatacgaaggtatcctgccgctgacaggagtacgtatgtccgaagatatctttgatgccatcatcgtgggtgcaggtctggccggttcggttgcggcgctggtgcttgctcgcgaaggtgcacaggtgctggttatcgagcgcggcaattctgctggcgcgaagaatgtcaccggtgggcgtttgtatgcacatagcctggaacgcatcattcccggctttgcggatcaggcccccattgaacgcatgatcacccacgaaaaactcgcctttatgaccgacaacggggcgatgactatcgactactgcaatggtgaagatgcttcagcgtcgcaggtttcttattccgttttgcgtagtaaatttgacgcctggctgatggagcaggccgaagaggcgggggcgcaactgatcactggtattcgcgtggataacgttgttcagcgtgatggcaaagtcgtgggcgtggaagccgatggcgatattctggaagccaaagtcgtaatcctcgctgacggggtgaattctctgctggctgaaaagctgggcatggccaagcgtgttgaggcatcgcatgttgccgtcggtgtgaaggaactgatcgaattgccgaagtcggtcattgaagatcgtttccagctacagggcaacgaaggtgccgcctgtctgtttgccggggcgccaaccgatggtctgatgggcggtggcttcctgtatacgaatgaaacaaccctttccctagggctggtctgcggtcttcatcatctgaaagacgcgaaaaaatcggtcccgcaaatgctggaagatttcaaacagcatccggccgttgcgccgctgatcgccggtggcaagctggtggaatatgccgcacacgttgtacccgaggcgggaatgaatatgcagcctgaactggtgggcgatggtgtactgattgccggagacgctgccggcatgtgtatgaacctcggctttaccatccggggtatggatctcgccatatccgcaggcgaagcggcggcgaagacggtgctttcggcgatgaagcgcgacgattttagcaagcagtcgttgggtgaataccgtcagcatctggacgaaggtccgatgcgcgatatgcgcatgtatcagaaactgccagcttttcttgataatccccgcatgtttaccgcctatcccgaaatggcggtcagtatcgcgcgcgacctgttcaccgtggatggctccgcgccggtgcccatgcgtaaaaaaatcctgcgccatgcgaagaaagtgggcttcatcaacctgatgaaagatggcctgaaaggagtgaccgtattatgacatctcccgtcaatgtggacgtcaaattgggcgtcaataagttcaatgtggatgaagatagcccgcacatcattctcaaaaccgatcctgataaacaggcgctggaggtgctggttaaggcctgtccggcgggactgtataaaaagcaggacgacggtagcgttcgttttgattacgccgggtgcctggagtgcggaacatgccggatcctcggccttgatacggcgctggaaaaatgggaatacccacgcgggacgtttggcgtggagttccgctacggctaataagtacgagtttgtgcccccgtaggccggattagatgcggtagcgtcgccatccggcaatcatgtggcgccaatgccggatggcggcgtaaacgccttatccggcctacagatgacgctttgcccgtgttgaaacaggacatcaccatgccgcagcccaggaactttgacgaccttaaattctcctccatccatcgcagaattatgctgtggggaagcggcggcccgttccttgatggctacgtgctggtgatcattggcgtggcgctggaacaactgacgccgctattgcaccttgatgctgaatggattggcgcgctcggcgcggctacgcttgccggactgtttatcggcacctcgttgtttggctatatttgcgataaagtcgggcggcgtaaaatgttcctgcttgatattatcgctatcggcgttatctccgtggcgaccatgtttgtttccacgccgcttgaattgctggtgatgcgcgttttaattggcattgttatcggcgcggattaccctatcgccacttccatgattacggagttttccaacacccgccagcgtgcgttctccatcggttttatcgccgcgatgtggtacgtcggcgcgacctgcgccaacctggtgggttactggctgtatgacatggaaggaggctggcgctggatgcttggcagcgcctttatcccgtgcttaatcattttgattggccgctttgacctgccggaatcgccacgctggctattgcgaaaaggacgggtaaaagagtgcgaacaaatgatgatcaaactgttcggcgaaccggtctgctttgacgatgagccgccgcaggagacccgcttcctgcagctgtttaaccgccgtcatttcccgtttgtactgttcgttgcggctatctggagctgtcaggtgatcccgatgttcgctatctatacctttgggccgcagatcgtcgggttactcggctgggaacaggggcgcaacgcggcgctcggcaatgtggtgattagcctcttttttatgctgggctgtataccggcgatgttctggctaaacagtattggccgtcgccctctgcttattggcagcttcgccatgatgactatcgcgctggcgctgctggggctggtgtcaaatctgggtatcatactggtcgtggtggcgtttgcggtatacgccttcttttccggcggaccgggcatactgcaatggctttatcctaatgaactcttccctacggatattcgcgcttcggccgtgggggtcatcatgtcattaagccgtatcggaaccattgtctccacctgggcattaccgatttttattactcgttacggtattaataacgtcatgctgattggcgcgttgatttcgttagtcgggcttggcgtatcggtgatgtttgccccggaaactcgcggcttgacgctaacacagaccggaaacatgactttgcgcggaacgccatcggataaccctcgttaagagtgttctgcatttctccctgcttttcgccaataacgctacagttaacagtcacatgctaaaacaactgaaaagcagggagaacaccatgcaaaaacgtcttatgaccgcactgtttaccgcagcaacactattcaccgtcgcaggatgctcttctaaccaggcggttgaaaccacggatggcaaaactattgtcaccgacgggaaacccgaggtcgataacgataccggtatggtgtcttacaaaaacgccgccaccgggaaaaccgaacagattaaccgcgatcagctgaaaaatatgagcgagctggataattaattcaattttttctggttagccgcgcaataatattctctctttatgcgcatccatttattcccatgcgaataaacggatgcctgaactggcagggacgccggaaaacgtcgaaatacgttcgcccgtgttcccgctttccccaccgcgctgtccgcttacatgaggttacactcatcgacatttctctgaacagcggctcaacatttcccggaaaaaacatatcgcaaggcatttatccttatgattaggtataaatgattaggtataaggaaacggagtctgtaatgaaactgaaactaatacctttttatttgctcgcgctattttctgccgcctccggggctacggagataaacgcctgcaaagacctgatcggaacatggaaaaccactgcagataacccgccttataccatgacaatattgccgccagtagaaggctgcggggaaaaatgtgtgaaactgaacgtacagtatgaacttgacgtgactcaccgcaacgcgctttattgccatgaaggacaagagggggtaaaagggcagggacccatggtgatagcatttgaaggggcgtatggtggacacgctattggaacctataaccgacagctgcaattactttgggctggcgtaataccgaaaaataaaaaggggaaatggataacgaaaatggaaaattactggttcaggcaggtaaaagcgcactaaatattaccttaaaacagcccgcaaaaccgtcttattcacgaagggcttactgcctgcgcgcgcacattccaacggcttgcctgccccggatgaactgttgataaaaaagagggccagcatctgtttccagacggccctgagtggattgtgacgtaacatggcaccttgctggcgctctcttattatttcatgccagtgccatcgttatggcgcaatcagagctttatttcgtcgcatcgttataaacttcggcaacggcttcaaaattcggaccatgctcacgtgcagcgataatatggtaatattttccgcctttcgcatcggctaattctgacagtttttcgcgtagatcagagggtgaggaaatctgcccgccactctgggacacatttatggtgccgaccttaaccagtttgaagtggctgatttcttgcttagagacctgctctgccgcaagtgtgctgaatgaagcaaccgttgccagtaatgcggcggcaatgatgcgttttttcatagttctgttcctgttgcattgatgataaggtttgcgcaatatcagtaatccgtaacgaaattatttatacccttcatacttcaggttgcttatgtgttggctacggattactcggcccacccatgggcctcgccctgacgggccgtcgcacgcgacgttcaaatctgctcccggcagatttgtcgctcacctcagtcacataattatctatgctcctggtgactcactcccttgccgcctttaagcaactcgaattattttgggtaataacctcggttgattatctgaaaatagccttatttggtgtgaccgtcttatatcttgttatagtcacctctttatgttgttgtcaatgtaaaataatgcgctgccagctaaaaagaaacttaaccccctgtaaataatagtttttatattatttcttttaatggcgtaatttttattgaatcacgcgacaatacgctagttttattcataagcaacataacagaattgagttatgttttaatttcccagagtgatattaccggttgtatgtctatggttgcgcggcctgttactgatagtgtttctttcggggcgattttattgtaacggcatagggtaatcaccgtagctgaagggaaaaggcacgaacacagcgctatagagtatgtttaataatgtatttttttatgaagtaatgtctgcagttgtatctctaaaataaaaacaatgaacttttcatctaaataatttttcagtgaattatggttatttattaatatatttctaatttgaaatacaaatcaatttataacacatattcttacccggaaggcattgatacatatccacgcttcctcgtacagtaataaatgaatatgtgataaagttactgactacaggtataataatatgagtaataaaaaaaatctgtccgcagaagagacggatcttacgcgtaggaaactgttaaccagcgccggtattcttgccgccggcggtatgctatccggcgcggtaaaggctgatgaaaaatgcgccgtcaaggcgaaaccgacgtgggataaaccgtttactggcgaaatcccggaaaaattgccagaaggatataatattctgttagtcgtgaccgactaggagcgtttttttcctacgtttcctttccctgtacccggcagagagcggctcatgaaaacgggggtgacattctgtaatcatcagaataccagtaatgtctgtacgccttcccgctccgtattgtataccggcttacatatgccccagacaaagatgtttgataatctgggattaccctggatgccttatgaccttgaccccgctcttggaaccacaggccatatgatgcgggaactgggatactatacggcctataaaggtaagtggcatcttacagaaaaactggagaagcctttgcctgacgaaaaagatgaggatattgatgtcggggatattcctgaaccagaattacataaaattatggaaaaatatggttttgctgactatcacggcatcggcgatattataggccatagtaaaggcggctatttttatgattcaaccaccacggctcagactataaattggttaagatgcaaggggcagcccttgaatgaccaacacaagccctggttcctggccgttaacctcgttaatcctcatgacgtcatgtttattgataccgataaagaaggagaaaaggtacagtggcgtggcgagttggatcaggatgataataccctggcgcccacgcagccgccggaaaacgagctttatcaggcaagctggccgaactatccgctgccggcaaacaggcatcaatcattcaatgagcagggaagaccgccggcgcatcttgaataccagacggcgcgcgctgcgctggaagggcagtttcctgatgaagatcgtcgttggcgtaaactgcttgactactatttcaactgtatccgcgattgtgatactcaccttgaccggatattaaatgaactggatgccctcaagttaactgataaaacgattgttgtatttactgccgatcatggcgaattaggcggaagccatcagatgcacggtaaaggcgcttccgtttataaagaacagatccatgtaccgatgattatttcccacccggcgtaccccggtaataagaaatgtcaggcgttgacctgtcatcttgatattgcgccgacattagttgggctgaccggtttgccggaagaaaaacagcaccaggcgttaggcaaccgcaaaggcgttaattttagcggattgctaaaaaacccggagagcgttgcggttaatgcggtgagaaatgccagcttatattgctatggcatgatcttgtataccgatgcccattatctccaccgtgttatcgcgctacaaagagataaacaaaaacggtggcgcaaatcaagcaggaaatatcgcatttgcatcctgatttcagccatcgttcagggacgcggatgattaacgatggccgttataagtttgcacgctatttctcgctaagggagcataatacgccggaaacctgggaggatcttattaagtacaacgatcttgaactttacgatcttaaaaatgatcctgatgagaaccataaccttgctgctgataaacagaaatatcaggatctcattcttacgatgaatgaaaaactgaataaaattatcaaagacgaaattggcgtggatgacggcagttttatgccggatgcggcccgtgagccatgggatcttactattgagcaatttaaccgcatggcgaaagattaagagcctgacccattaggttaatttatgcgtcggtgatctagcatccagcgtgtctggaggttcagatgctgttggcgctgcgcttattgggcctgtgtcatcatgtaatggattgatattacagtcattacaggaaaatttagcgcagcgccacccgacaagaaggccttaaaccgatttgtcagcaatttaaggctgccatcatcaccaacctttccacaccggatcgcgcttttccacaaacgcctgcggcccttcgagggcatcttccgggggcaggatggcgtcaactccttgctggcgttaattcaattttttctgattagccgctcaataatattcactattagcctggcgaatttgtcactacactttgtgataaaaaacagatcatcacaggctaatcatgatcctcattatttatgcgcatccgtatccgcatcattctcatgcgaataagcagatgcttgaacaggcagggacgctggaaaacgtcgaaatacgttcgctttatcacctctatcccgatttcaatattgacgtagccgccgagcaagaggcgctgtcgcgcgcgagtcttatcgtctggcagcatccgatgcagtggtacagcgtccctcctttactcaaattatggatggataaagtcctcacccacggctgggcttacggtcatggcggtacggcattgcatggtaaacatctgctgtgggcggtaacgaccggcggtggtgaaaaccactttgctatcggctcccatccaggatttgccgtcctttctcagccgctacaggcgacggcgctctattgcggcctcaaatggctgccgccgtttgccatgcactgcacgttcatttgcgatgacgacaccttacaggcgcaggcgcgtcagtataaacagcgtttactggcatggcaggaggtgaatcatggatagccatactctactgcaggcgctgatctatcttggttcagcggcgttgattgtgccgattgcggtacgtttgggcttaggatcagtgctggggtatctgattgcgggttgcattatcggcccctgggggctacggctggtgacggacgccgaatctattctgcattttgcggaaatcggcgtcgtgctgatgttgtttgttattgggcttgaactggacccgcaacggttatggaagctgcgcgcctcggtatttggcggcggcgcgttacagatggtggtctgcggcggactgattggtctgttctgtatgtttcttggcctgcgttggcaggtggcggaactgattggcatgacgctggcgctttcgtccacggctatcgccatgcaggcaatgaatgagcgtaacctgaccgtttcacaggtagggcgtagcgcatttgcagtgctcttgttccaggatatcgcggcgatcccgctggtggcgatgattcctctgctggccgccagcggcgcatccaccacgcttggcgcgtttgcgctatcggcgttgaaagtcgcaggcgcgttggcgctggtggtgttgctgggacgctacgttacgcgcccggcgctgcgctttgtcgcgcgttctggtttgcgggaggtgttcagcgccgtggcgctatttctggtgtttggtttcggcctgttgctggaagaggttgggctgtcaatggcgatgggcgcgttcctggcgggcgttctgctggcgagttcggaatatcgtcatgcgctggaaagcgatattgaaccctttaaggggttgctgctggggttgttctttattggcgtcggcatgtcgattgatttcggcacgctggtggagaatccgctgcgcattctgctgttgttggccggttttctggcaatcaaaatcgtcatgctgtggctggtcgcgaggaccctgggcgtaccggcaaaacagcgtcgctggtttgccgtcttattaggccagggaagtgagtttgcgtttgtggtttttggcgcggcgcaaatggcggatgtacttgagccggaatgggcaaaagcgctgacgctggcggtcgcgctgtcgatggcggccacgccgatttttctggtgctgctgacgcgcatggaaaagaccgcaacgggtgaagcgcgcgaggcggatgaaatcgacgaagagcagccgcgggtcattgtggccgggtttgggcgatttgggcagatagccgggcgtttactgctgtcgagcggggtgaagatggtggtgctcgatcacgaccccgatcatatcgaaacgctgcgtaaattcggcatgaaggttttttatggcgacgcgacgcgtatggatttgctggaatctgccggagcggcgaaggcggaggtattgattaacgccattgacgatccgcaaaccaatttgcaactgagtgaactggtgaagacgcatttcccgcatctgcagattatcgcccgcgcccgtgatgtcgatcattacattcgcctgcgccaggctggtgtggcgatgcccgaacgtgaaaccttcgaaggcgcgctcaaaagcgggcgacaggctttggaggcgctggggctggggcgttatgaagcccgcgagcgcgcggatctgttctgtcattttaatacccggatggtggaagagatggcgaaaggggaaaacgatccgttatctcgcgccgccgcctataaacgtaccagcgcgatgttgagcgaaattattaccgaggaccgggagcatctgtcgttgattcagcgccacggctggcagggaacggctgagggcaaacattccgggaaggccgctgatgaacccgaggtcaaaccgtcaatctaaagtaaaaaatgtgatgttctgcaaactttactgctaattggctgtttttgaactactgtaatgctggcgctccacatcaaatgagtggcgtcgccagcagaacgaaaaattttcgtgctcatcctcttttcgtcagtcgacgaaagattgcgctttacgtatagtggcggcaattttttttgtatcaggaaataattaatgatcagtctgattgcggcgttagcggtggatcgcgtcatcggtatggaaaacgccatgccgtggaacctgcctgccgatctcgcatggtttaaacgtaacacgttaaataaacctgtcgtcatgggacgtcacacctgggagtccatcggacgccccttaccgggacgtaaaaatattattatcagcagccagccgggcaccgacgatcgcgtgcagtgggtgaagtctgtcgatgaggcgattgccgcttgcggcgatgcgccggaaattatggtcattggcggcgggcgcgtgtacgagcagttcctgccaaaggcgcagaagctttatctgacgcatattgatgcggaagtcgaaggcgatacccattttccggattatgaaccggatgactgggaatcggtattcagtgagtttcacgatgccgacgcgcagaattctcacagctattgtttcgagattctggagcgtcgttaacgctgtagtgccggatggcggcgaaatgccttatccggcctactcttgagccggatgtaggcctgataaacgtagcgccatcaggcataaacctatcaggcgttgaccgcttcgccttcgcccatatccatctggcggtttgacggctgcacaaaatactgtttatcttcccaacgtaaacaggttaactccccgccccagcagcagccggtatccagcgcgtaaataccttctggcgtccctttcccttccagcgacgcccagtgcccgaaagcaatactgtaagcctcgctcaccggtcccggaatggcgaaccacggcttcagcggcgcaggggcattttccggcgacgctttgctgtacatatccagttgaccgttaggaaagcagtaacgcatacgggtaaaggcattagtaataaagcgtagccgcgccagaccgcttaactccggcgaccagttattcggcatatcgccatacatcgcgtcgaggaaaaacgggtacgagtcgctcgacagcaccgcttcaacatcgcgggcgcactcttttgccgtctgcaaatcccactgtggggtaatacccgcatgcgccatgaccagctttttctcttcatctacctgcaacagcggctgacggcgtaaccaattcaacagctcatcggcgtccggcgcttcaagaagcggggtcagccggtctttaggtttgttgcggctaatcccggcgaatacggccaacaggtgtaaatcgtgattccccagcaccaaacgcacgctattgccaagcgatttgacgtagcgtaacacgtccagcgaaccgggaccgcgggcgaccaaatcgccagtcagccatagagtgtctgtatctggcgtaaattccacttgctgtaataaggcgatcagttcgtcgtagcaaccgtgaacgtcgccgatgagataagttgccattgttataattttagtgaatgagtgtagggacggcgagtcgaaacacgggaatgtcgatggtaaaggcgtcgccattttcatcgatcatttcgtaatgaccctgcatggtgcccagcggcgtttcaattaccgcgccgccggtgtactgatactcttcgccaggcgcaatgcgcggctggacgccaaccacacctttgccctggacttcagtttcacggccatgaccattggtaatcagccagtagcggcccaatagctgcactggcgcccgacccagattgcggatggttacggtataggcaaaaacgtaacgttcatcgtcaggtgaggattgcgcctcaatgtagacgctttgcacctgaatacacactctgggcgaattgatcatgtttaactctccttcaaaggcgcgttttccgacagatagttggccatctggcagtactgcgcgacagagatattttccgcgcgcattgccgggtcaatacccatttccgtcaacgtctcaacgctaaaaagattgccgagactattacggatcgttttacggcgctggttaaaggcctcggtggtaatacggctcaacacgcgaatatctttaaccgggtaaggcatcgttgcgtgtggaaccagacgcaccacggcggagtccactttgggcggcggcgtgaaggcggatggcggcacttcaagcaccgggatcacctgacagtaatattgcgccatcacgcttaaacgaccatacgctttgctgttcggccctgcaaccagacgatttaccacttctttttgcaacataaagtgcatgtcggcaatggcatcagtatagctaaagagatggaacatcagcggggtggagatattatagggcagattgccgaacacacgcagcggctggcccaactgcgcagacagttcgccaaagttcatggtcatggcgtcctgctgataaatagtcagcttcggccctaaaaacggatgggtttgcaaacgcgccgccagatcgcggtcaagttcaatgaccgtgagcttatccagtcgttcgccgaccggctccgtcagcgccgccagaccggggccgatttcaaccatcgcctggcctttttgcggattaatagcagaaacaatactgtcgatcacaaaccgatcgttgagaaagttttgcccgaagcgtttacgggctaaatggccctgatggactcgattattcattgggtattaacaatcattttgatggcgagattaagcgccgtaataaaactgccgacatccgcttttcctcggcccgccagttcaagcgcggtgccgtgatcaacggaggttcgaataaaaggtaggccgagcgtaatattcactccccgaccgaatccctggtattttagcacgggcaggccctgatcgtggtacattgccagcaccgcgtcggcattatcgagatatttgggctgaaacagcgtatcagcaggtagcggcccgttgagtttcatcccctgcgcccgcagctcgtcgagcaccggaatgatggtgtctatctcttccgtgcccatatgaccgccttcgcccgcgtgcggattcaggccacagacaagaatgcgcggttcggcaataccaaatttggtccgcaaatcgtgatgcaaaatagcaatcacttcgtgcaaaagcgcaggggtgatggcgtctgcaatcgcccgtagcggcagatgcgtggtcgccagcgccacgcgaagttcttcggttgccagcatcatcacgacttttttcgcctgcgaacgctcttcgaaaaactcggtatgaccggtaaacggaatgcctgcgtcgttaataacgcctttgtgcacggggcctgtgatcagcgcggcaaattcaccgttcagacagccatcacacgctcgcgccagcgtctctaccacgtaggggccattttctaccgtcaactgaccggggatggcaggcgcgcgcagcgagaccggcaatagggtcagcgttcccgcgggctgcggcgcagcggggacatcaggcgagtaagggagaagcgagaggggcaggccgagcatggcggcccgctccgtcaggagcgcgccgtccgcacagacgaccagttcaatcggccacgcgcgttgcgccagttggacgacaagatcggggccaatcccggcgggttcgccgggagtgataacaacgcgttgcgcactgctcattagttactcaaaatcttaacgtaagcgctggcgcgctgttcttgcatccaggtcgccgcttcttctgagaatttacggttcatcagcatacgataagcgcgatctttctgcgccgcatcggttttgtctaccttacgcgtatccagcaattcgatcagatgccagccgaaagaggagtgtaccggcgcgcttatttggcctttatgcagcttcgttagcgcgtcgcggaacgccggatcgaaaatatctggcgtagcccaacccaaatcaccgccttggttagcggagcccgggtcctgagagtactctttcgccgctgcggcaaatgtggttttaccactcttaatgtcagccgcgatttcttccagcttcaggcgcgcctgctgatcgttcatgatcggcgacggcttaagcagaatgtgacgagcgtgaacttcggtcacggagatactctggctctgaccgcgcaggtcgtttactttcagaatgtggaagccgacgccggagcgaatcgggccgacaatgtcgcctttcttcgcggtgctcagcgcctgggcgaaaatccccggcagctcctgaatacggccccagcccatctgaccaccttttaacgcctgctggtcggcagagtaggtaatcgccagtttgccgaaatctgcgccgttacgcgcttcttcaacaatgctttccgcctggcgctgcgcgtcgttaacctgctcggaggttgggttttccggcagagcaatcaggatatggctcaggttcagctcggtgctggcgtcgttttgggtgccaatctgttttgccagcgcgtcaacttcttgcggcaaaacggtgatacggcgacgaacttcgttgttgcgcacttcagagataatcatctctttacgaatctggttacggtaggttgaatagttcagcccatcgtaagccagacggctgcgcatctgatccatcgtcatattgttttgtttggcgatgttggcgatggcctgatccaactgctcatccgtgatcttcacccccatcttctgacccatctgcaggataatttgatccataatcaaacgttccaggatctggtggcgcagcgtggcgtcgtccggaagctgctgacctgcctgacccgcgttgagtttgactgattgcattaagccatcaacgtcgctttccagcacgacgccattattgacgacggctgcgactttatcgactacctggggggcagcgaaactggtattcgcgatcatggcgataccgagaagcagcgttttccagttcttcatactttttccatttcaattaaccgcaatgcggattacgttgtaaatcaatcagattacatagagctttggtacggcagaatgttcgaacgcaacatttcttgcgtgccgaggccgtagttagagctcaaaccgcgcagctcaatgttgaagccaatcgcgttatcataaatcgcgtgttgtttatcgttatcccaaccgttcagcttacgttcgtatccgacgcggatcgcatagcagcaagagttgtactgcaagccgagcatctggtctgcaggtttgctcgaattggtatcgaagtagtacgcgccgacaatcgaccagcgatcggcaatcggccaacttgccaccgcgcccacctggttgatgccgtttttatactgctctgccgtggaataatacgaaggcaacgtagcctgaatatattccgggctggcatagcggtagttcaactgtaccagacgatcctgatcccgacggtattcgaggctgctgctgctggtagcgacgctatccagacgggtatcgtactgcactccgctacgcagcccccagcgttctgaaatacgccagtaagtgtcacctgcccaaaccagcgaaccggttttgtcgtcattctcccatttaatgttgtcatcgccggtgcgagactccgtgaaatagtagatttgaccaacagaaacgttaaaacgttcaacggcggcatcatcataaatgcgtgttgtgacgccggtcgtgacctggttggcggaagcaatacggtcgagaccgccataagtgcggtcgcggaacaggccgttatagtcggattgcagcaaagaagaatcgtagttatagatgccgctctggtcgcggtacggcacatacaggtactgcacgcgtggttccagcgtttgggtataccccggcgccagcatcgccatatcgcgttcgaagacgagcttaccgtcgactttaaactgcggcatgacgcggttaaccgaatcttccagttttttgctgttattggcgttgtaccagtccagattcgtctgctgatagtgcgtcgccatcagcttcgcttcggtgttcagactgccccagcggttggagagcggcagactaatggtcggctccaggtggacgcgggtcgcttccggcatattgtctttggtgttgacaaagtgcaccgcctgaccgtaaatccgggtatcaaacgggccgagatcgttatggtagtagttaacgtctaactgcggctccgctgaatagctgctggtgttctgatcgttaaagacctggaattgtttggtcgacaccgtagcgtcaaagttttgtacggcgtagccgacgctgaatttctgcgttgcgtagccgtcggtactggaaccgtacttactgtcgaaatcattaaagtagctggagtcgctgactttggtgtaatcgacgttaaaacgccacacctgatccatcacgcctgagtgctgccagtagaataaccagcggtgcttatcgccctctttgggatgttcgtcctcgtagactttatcagaaggcagataatctaattccatcaacccggcgccggcctgcgtgagataacggaattcgttctcccacataatattgccgcggcggtgcatatagtgcggggtgatggtggcgtccatattgggcgcgatgttccagtaatacggtaagtagaactcgaaatagttcttggtcgtgtatttcgcgttcgggatcaggaaacctgagcgacgtttgtcaccgacgggtagctgtaaataggggctataaaagatcggaaccggacctactttaaaccgggcgttccagatctccgcaacctgttcttcacggtcatggatgacttcactccccaccacgctccaggtatcggagccaggcagacaggaggtaaagctgccgttttccagaatggtatagcggttttcgccacgctgcttcatgagatcggctttaccgcgcccctgacggcccaccatttggtaatcgccttcccagacgttcgtgtctttggtgttcaggttcgcccagcccttcggccctttaaggatgacctgattgtcatcataatgcacattacccagcgcatcgacggtgcgtacaggttccggctgaccttccgcctgcttctgatgaagctgcacttcatccgcttgcaggcggctattcccctgcataatgtccacgttgccggtaaaaacggcatcgtccgggtagttacctttagcgttatcggcattgatagtaaccggcagatcgttggtatcgccttttaccagaggacgatcgtagctcggcacgcccaacatacactgtgaggcgagatcggctgccagcccctgatgactataaagggcgctggcgatcatggtggccagaagagtgggaatacgttttttcatacgttgtatttattgttccatcatcggtagcgttgcgcgtgacaaacggtcacagcctaacttactcatcttcgctgcgccagtgttaatcctgccgtttagcgtctgtggtgttaggcacggcattgaatgacaggtatgataatgcaaattataggcgatgtcccacaaatgaccgtagccttcattcgcggaaaagcaccttattttgtgggagatagcctcaccgatagcgtaacgttttggggagtctatgcagtactggggaaagataattggcgtcgccgtagccctgatgatgggcggcggcttttggggcgtggtcctgggtctgctggtgggccatatgttcgacaaagcccgcagccgaaaaatggcgtggtttgccaaccagcgggaacggcaggcgctgttttttgccaccacctttgaggtgatgggccacttaaccaaatcaaaaggacgggtgacggaagcggatattcatatcgccagtcagttgatggatcgtatgaatttacacggcgattcacgtactgccgcgcagaacgcctttcgggtcggaaaagcggataattacccattacgtgaaaagatgcggcagtttcgtagcgtctgcttcgggcgttttgatctgatccggatgtttctggaaattcagatccaggcggcgtttgccgatggttcactgcaccctaatgagcgggaagtgctgtatgtgattgcggaagagttaggtatttcccgcgtacagttcgatcagtttctgcgcatgatgcagggcggcgcgcagtttggcggcggttatcatcaacagtccggcggcggctggcagcaggcgcagcgcggcccgacgctggaagatgcctgtaatgtgctgggggttaaaaccaccgatgatgcaaccaccattaaacgcgcttatcgcaaactgatgagcgagcatcatcccgataagctggtggccaaagggttgccgccggaaatgatggagatggcgaagcaaaaagcgcaggaaattcagaaagcgtatgagctaatcaaagaacagaaaggcttcaagtgattgaattgccggatgcggctagcgccttatccggcctacgttaatgaatgtaggccgggcaagcgaagcgctccggcataaattggctcagaatttaaaaatctgccgggactttaaacgtcatgctgttaccgtaagcgggatgggtaatggtcagcatttcggcgtgtaactgcaaacgcggcgccagcgacaacgcttccggcgaggcgtaaaactgatcgcctaagatcgggtggcctaacgccagcatatgcacacgcagctgatgcgaacgcccggtgatcggtttgagcaccacgcgggcggtattatccgccgcaaattccaccacgttatattccgtttgcgccggtttgccggtttcataacacactttctgctttggccggttcggccagtcgcagatgagcggtaagtcgaccagtccttccgccggggagggatgcccccatacgcgcgccacatactgctttttcggctcacgttcgcggaactggcgttttagctcccgctccgcggctttggtcagcgccactacaatcacgccgctggtggccatatccagacgatgcaccgactctgcctgcgggtagtcgcgctggatacgcgtcataatgctgtctttgtgcgcttccagacgccccggcacggacaacaggccgctgggcttattgaccaccataatgtgctcatcctgatacaggataaccagccagggttcctgcggcggattgtagttttccatccccatgtacggctccgttattggtgcgtgacgacgataagacgcagcgcgtccagacgccagcctgcctgattcaggctttccagcacctgctgacggttgctgtcgatagcggcaagttcgtcgtcgcggatgttcgggttgacggcgcgcagcgcttccagacgcgacagttccccggacagtttttcatctgcctcgcggcgcgcgttatcaatcagcgctctggcggactgttcaatctgcgtctcgcccagttgcaaaatggcgtggacgtcctgttgaacggcgttcaccagtttgctaccggtgtggcgattcacggcgctgagctggcggttgaaggtttcaaactcgacctgggcggccagattgttgccgtttttatctaacagcatacgtaccggcgtcggcggcaggaagcggttcagttgtagctgtttcggcgcctgcgcttccacgacgtaaaccagttcgaccagcagcgtgccgacgggcagcgctttatttttcaacagcgaaatggtgctgctgccggtatcgccggagaggatcagatccagtccgttacggatgagcggatgttcccaggtaataaactgcgcatcttcgcgagacagggctacgtcacgttcaaacgtgatagtacaaccgtcttccggcaggccggggaaatccggcaccaacatgtggtcggacggcgtcagcacgatcaggttgtcgccgcgatcatcctggttaatgccgacgatatcgaacaggttcatggcgaacgcgatcaggttggtgtcgtcgtcctgttcttcaatgctttgtgcaagctgttgggctttttcaccaccgttggagttgatctccagcaggcggtcgcggccctgttctaactgggcttttagcgcttcatgttgttcgcggcaggatttgatcagatcgtcaaacccgtcggtttcttcaggcgcggccagatagttaatcagactggcgtaggctgaatcataaatcgcgcgaccggtcgggcaagtgtgctcaaaggcgtccagcccttcgtgataccagcgaaccagcaccgactgggcggttttttccaggtacgggacgtggatctggatatcatgcgcctggccgatacgatccagacgaccaatacgctgttccagcagatccgggttaaacggcaagtcgaacatcaccagattgctggcaaactggaagttacgtccttcggagccgatttcggaacataacagcacctgcgcgccggtatcttcttcggcgaaccaggcggcggcgcggtcgcgttcgataatcgacatgccctcatggaacacggcggcgcggatgccttcgcgttcgcgcagcacctgctccagctgtaacgcggtggtcgccttggcgcagatcaccagcactttttgcgaacgatggctggtcagatagcccatcagccactcaacgcgtgggtcgaagttccaccaggtgccggtatcgccttcgaactcctgataaatttgttccggatagagcatatcgcgggcgcgatcttccgcgcttttacgcgcgcccataatgccggagaccttaatggcggtctgatactgggtcggcagcggcagttttaccgtatgcagttcacgtttcgggaaccccttgacgccgttacgggtgttgcggaacagaacgcggctggtaccgtggcgatccatcagcatcgacaccagctcatcacgggcggcctgcgcgtcgtcgcgatcgctattagcggcctgtaacagcggttcaatatcctgttcgccgatcagatcgcccagtctgttcagttcgtcgttgctgagtttattgcccgccagcagcatggccaccgcatcggcgacagggcggtagtttttctgttcttcgacaaactgttcgaaatcgtggaaacggttcggatcgagcaggcgcagacgggcgaaatggctttccatccccagctgttctggcgtggcggtcagcagcagcacgcccggcacgcgttcagctaactgttcgatggccatatattcacggctcggcgcatcggtgctccacaccagatgatgcgcttcgtcgaccaccagcaaatcccactcggcgtcgcacaaatgttccagacgctgcttattgcggcgggcgaaatccagcgagcagatcaccagttgttcggtttcaaacgggttatacgcgtcgtgctgcgcttcggtatagcgttcgtcatcgaacagcgcgaagcgcaggttgaaacggcgcagcatttctaccagccactggtgttgcagggtttccggaacgatgatcaatacgcgttccgccgcgccggataataactgttgatgcagaatcatcccggcttcaatggttttacctaagcccacttcatccgccagcagtacgcgcggcgcgtggcgacgacccacatcatgagcgatattaagctgatgcgggatcaggttggtccgctgaccgcgcaggccgctgtatggcatccggtactgctcgctctgaaatttacgggcgcgatagcgcagcgcgaaccgatccattcgatcgatttgaccggcgaacagacgatcctggggcttactgaaaaccaacttgctgtcgagcagaacttcgcgcaacgtcacattggtttcttcggtatccaggcgggtgccgacataaacaagcaggccattttcttcttttacttcatcgatatgtagctgccagccttcatggcttgtaatcgtatcgccagggttgaacatgacgcgggtcacgggagaatcactgcgcgcatacaggcggttttcccccgtggacgggaaaagtaaggtgacggttcgcgcatccatcgcaacaacggttccaagtcccagctcgctttctgtatcgctgatccagcgttgaccaagtgtaaaaggcatatgtgttcggctctatatctttaattgcaggcattactcgccattcccaggcgacagcactggataattgcgagtatacgaccccgctaccaggctaatgtggtagtggcgttaattaggtccaggaatggaaagggcgctatggtactggaaggcggcgctttcgtcacgcgtcaaaataaccccagttgcccggtcagtagtgtagcaaaattatcttcaacgaagggaagaattccttccgccacgggttgtagctggcgggtaagatagtgttcgtaatccagcggcgactgctggtaatccacgggctcggggccgttaacagtccagacatattttatggcgccgcgattctgatactgcgccggacgaccctgcttcaggttttgttcatccgccagccgggcggcgcgaacgtgcgacggaacgttacgctggtactcatgtaaagggcgacgcagacgcttacgataaaccagctgcgcgtccagttcgcccgccatcagtttatcgatagtctcgcgcacatagtcttgataaggttcattgcgaaaaacgcgcagatacagctcctgttgaaagcgctgcgccagcggcgtccagtcggtccgcaccgtttccagacctttaaataccatgcgctggctgtcgccttcctgaatcaggcccgcgtagcgttttttactgccagtatccgcgccgcggatggtcggcatcagaaaacggcaaaagtgagtttcaaactccagttccagcgcgctggtcaaattttgctgttgtaacgtctgcgcccaccattcgttcacgtgacgcaccagcctgtgcccgatttccgccgcatcggcttctgaatgcgcgcgccggagccagacgaaagtggaatcggtatcgccataaatcacgtcataaccctgcgcctcaatcagcgctttggtctggcgcataatcgcatgaccgcgcatggtgattgacgacgccagacggggatcgaaaaagcgacaggccgtggtgccgagtacgccataaaaggcgttcataatgattttaagcgcctgcgagagcggtttattgccctgacgtttggcttcatcgcgcccgtgccagatttggctaacaatttccggcaggcagtgcttttctcgtgaaaaccaggcgtcaaggaaaccttcggtactgtgttccgggtccggctgcgccatgccttcgaccagcccgacgggatcaatcaaaaacgtgcggataattgacgggtacaggcttttataatccagcaccagtactgaatcgtataatccgggttgtgaatccattacgtagccgccgggacttgccagcggcggcacttcgccgagattgggcgcgatatagccggcgcggtgcattcgcggaaagtaaagatgcccgaatgcggcgaccgaaccgccgtggcgatcgaccggcaggccgttgatcgtcgcgcgttccaacaaaaacggcatgatttcggttttatggaaaatgcgcgtgaccagctcgcagtctttcaggttgtaggtggcgagggcgggtttatcctgggcaaagcggcgatcgatctcatccatacgatcccaggggttatcaatggattttccttcgccgagcagttcctgcgagacggcttccagcgaaaaagacgaaaaattccagaacgcggatttaagcgcgtcgataccatcgataatgactcgccctctggcctgggcgaaaaaaacgccgtttttgaagccatgttcgcgccactccagttcgctattgtctcgccccagccgtaaagggatacggtagcgttcggcatatttttgcagcatacgcaggtcgaactgcaccacgttccagccgatgatgacgtcaggatcatgttcggcaaaccaggcgttgagtttttccagcaactgcgggcggctggcgacatacacaagctcgaagtccagttggcgctcatcgccgttcgccgggcccagcatataaacggtacgctggccgcagccttccagaccaatgcaatacagctcgccgtgtcgcgtggtttcgatatccagcgagacccattttagcggcggtcgatagtcggggtggggtttaagacgcgcattgcggataacgccgttgcgcatctcgccatctacccaaacaggcgaagtgataaaacgttccatcaggtaacgctccggcgggcggacatccgcttcataaacggtgacgccgttttcgcgcagcagtttctccatccgcataagctggcggtgagtgcggcaatacagaccggataccggctgacggtgaaagtctcgcagctggagcggcgtcaggcgatagtctttttccgcctgtagcagcgaggcggcgcgggaggtctggctggtcggaataaacgccacggactcttgcggcgccagcgtcgcctgcaaagggccgttgtctgtcgccagccagaaagagacctccgtcccttgcggcgtatcccgccagtgccgggttaaaatgaaacctgcctgcgccacgatgattacctgtctaaaaaattcacgctaattataacctgttttagggggtaatactgttattttgtacaggcatataacgtaaaagccgatatccgctgtaataaaaagtttctcgcagtaagaagcgggtttgcgcccaccaggatttatagcgggtggctcgcgtgggtgatgagcggctatcgataccattatcctgagcgatagttttcagacgcagcatatgcagcggatcgctgaccagtaacgctgtgcaccatcttaactccaaagggtactcccgccgacataaggcgggaggggaatttggacgggcttgaaaagcccgaaggatcatcagccacgctgatgttgaatgtattgcttcacaacttccagcggcgcacctccgcacgagccagcaaagtatgacctcgaccagagcacggcttttccgtatgctccccgcaaatcaataaattcgtttcgcagacggcgggatgtcacagctttcagtgagttaaccagtaccgaaagctgcactgttggtgggtattcgatcagcatgtggacatgatcgacgtctccgttactttctttaagttctccgccaaaatcacggcagacttctgctgcatactgatggaatgcagcatagtgtgactcacccagtatctttcgacggtattttgttataaagacaagatgaacatgcaaaaggaaggcggcatgtcttgaacgattaattttatgtttttgtattgaagttgaccgtaaaaacagtaacgtagcaaacaaatctcctacacactgagtgatgatgctaatcctgaaagcctacaaattcagactggaaccaacgcctgaacagtcgcagcgtttgcggcagttatgtggttgcgcccgttttgtctggaatttaggtcttgcggagacaaagcgcatccttggttcaggcgaaaagttaccttcggctttcgagttgaacaggatgcttacagtgtggaaaaaaatgccgggacacatctttttacaggatgcttataccgacaatctgcaacaaaagttgaaagacctgcatactgcatggaaacgttgctttgataaaaagctcgcagctaaggccccggtatggaaacgaaaaaatgagggcagagactcaatccgttttgtgaactttgagaaatattgccgccttgaaaatcgcagagtgaagctaccgtcaggtcttgggtgggtaaaattccggcaatctcaacgtgtgaacggtaaaatcaaaaatgcgacaatcagtcagttagcgggacagtggtatatctcgtttcaggttgaagttgaaacggcagaacccaatcacacaagcacaacgatagtcggtctggacgcaggagtaacaaaactcgccacgctttcagacggtacggtataccaaccagtcaacagttttaaagcaagtcagcgcaagctggcaacactccagcggcagttaagccgtaaagtcagattcagcagtaactggcagaaacaaaagcgaaaagtccagcatctgcactcgcacatagccaatatccggcgcgactaccttcataaagttaccagtgaaatcagcaaaaaccacgcgatgatagtcattgaggatttgaaggttagtaacatgtcgaaatcggcaaaaggtacagcagaacagcacggacgaaacgtcaaggccaaatcaggtctgaaccgttcgatactggatcagggctggtatgaaatgcgccgccagcttgagtacaaacagctctggcgtggcggtcaggtgcttgcggttccgccagcatacacaagccagcgttgcgcgtgctgtggtcataccgcgaaagaaaatcgcctgtcacaaagtaaatttgtgtgtcaggcatgcggatatacagcgaacgctgatgtaaacggcgctcgtaacattttagcggcggggcacgccgttcttgcctgtggagggatggtgcagtcaggccgcccgtctgaaacaggaaccagacgctgagcaatcagtcgtcacccactaatgggaattccccacctgagtcacgaagtgcgaaggtgggggaggatgtcaatgttgttgtcgcagtatctgttttgcgtaacgaatattttcgcgcgtcacggtagagcgctcttcaataaaaatcgccttagccggaatgcctttttccagaacgtattgacgggctatcgccgcgtcggaaaccgttgcgccagcgccgtagccgccggttaataccaacgcgcggacaatgtgttgttggtaaagccagatggcatgatccagtctggcctgaaaaacgggagaaggcgtttttccgctaacgcctgctcctgcgacaatcgcgcagtcagctacgcgcgtctggttttgctgactgaactgataaatagcgatagcgttatggataaacaccatggccataatgagaatgatgcctgccgcgattctgaggatgtagcgatatttcatgaatgagttcgttccccgtgacgggtgtaatgaatattttaacgataaaatggcttttagcgtcagatatttttgctgacgtatatttatcaatataatgatgccggtatatacagcagatataattatcctataactgctaattttgaatcatgtttatttacagtttttacccatgtattagccgttttgtgtcaagtctgttttcatacattaagtatttttcagaaaggcgcttgttcgaatctgttacttatttctcggattaacaaaaaagcgatattttttgtttgttttaattaatgaaaagtgtaacaatttcatttggaacatccgcaccgtcaggtagaaatataatattccaattggccgctatggttaaataaaaatggattacagtgcgaattcgtcgggaactctctgcataatttaatttttattttagaatataattttattttgactttcgggtgcgggtgtttttatcaaaatttgtggtattcaggaatgatcttttatgaatgtgagtatgcaggcgcgtctggtagggagcgaccgttatcttttcgtcaatactcaacgcgctaacccttccataaaaaccgtgagtcgattttttgagtataaaacatggacagaacagatttggcgtaccgagattattgaaaacggcaatgctttttttcactggcaaggacacgacagaaaagacggacatcgggataccattattaattatctgttaaatgggcaacgctggcagtcaacaatcgaagattatattttcttccatgcgctggaaggaaaagcgtggcagggacattatgataatattattgaatatgtgagttctgatcattacgtctatcaaagcgcatttgctgaatatatcaccgaccagattcatcaacgcgccccccatgggacgcgtttttagaggcattactgcccgtaataggcttttgcgccgtgtttgcgtaaatagtgtttatccagcagggattgctgcatgtcgggcaactgcggcgcaagctggcggcagaagatccccatataggccacttcttccagcacgatggcgttatgcacggcatcctcggcatttttaccccaggcaaacgggccgtgcgaatggacaagcacgccgggcatttgagcggcgttaatgccttgtttttcaaaggcttcaacaatgacattgcccgtttcccattcatactcgccattaatttccgcctcggtcattttgcgagtgcagggaatcgtaccgtagaaatagtcggcgtgggtggtgcccgtcgccggaatcggctgacccgcctgcgcccagatagtcgcgtggcgcgaatgggtgtgtacgatgctgccgatagtcggaaatgcctgatataacagacggtgggttggcgtatcggacgacggtttcttatgaccttcaacgacttcaccggtctccaggctgaccaccaccatatcgtcagcggtcatgacgctataatcgacgccggacggcttaatcaccagtacgccgcgttcgcgatcgacggcgctaacgttaccccaggtgagggtgaccaggttgtgttttggcagcgccagattggcttccagtacctggtgtttgagatcttctaacattgttttctccctgccggatggcgcttcgcttatccggcctacgagcgacggtgtgccggatggcgacataaatgccttattcggcctacaggaccgtaggcccggtaaacgcagtgccaccgggcattcagacaccacttttagcgttttaaaccgtaatacacctcgttccagcgcagcgcgtccttaaaggctggcagacgggtatcgttatcaatcaccgcgatttcgatatcgtgtatttctgcgaactggcgcatatcgttcagatccagcgcgtggctgaagacggtatggtgcgcgccgccagccagaatccacgcttcggaggcggtcggcagatccggctgcgccttccacagcgcgttagccaccggcagtttcggcagggagtgcggcgtttttacggtgtcaatgcagttgaccagcaggcggtaacgatcgccgaggtcgatcaggctggcgacgatcgccgggccggtttgggtattgaaaatcaaacgcgccggatcttccttgccgccaatgccgaggtgctggacgtcgaggatcggtttctcttccaccgcgatggagggacacacttccagcatgtgcgagccgagcaccagatcgttgcctttctcgaagtggtcagtgtaatcctccataaatgaggtgccgccctgcagaccggttgacatcactttcataatgcgaagcagagcggcggttttccagtcgccttcgcccgcaaagccgtagccctgctgcatcagacgctgtacggccagacccggaagttgtttcagaccgtgtaaatcttcaaaagtagtagtgaatgcgtggaagccgccctgttccaggaaacgcttcatccccagttcaatgcgcgccgcttcccgcacgttctggcgtttatcgccgtggatctgggtggcgggcgtcagggtatagctgctttcatactcgtcaatcagagcgctgatatcgccgtcgccgatagaattcaccacctgcaccagatcgccgaccgcccaggtattgaccgaaaagccaaatttgatttgcgcggccactttatcaccgtcagtcactgcgacttcacgcatattgtcgccgaagcggcagacttttagctggcgggtatcctgtttagagaccgcctggcgcatccaggcgccgatacgcgtatgggcctctttatcctgccagtggccagtgacgaccgcgtgctgctggcgcatccgcgcgccgataaaaccgaactctcggccgccatgcgcagtctggttcaggttcataaagtccatatcgatgctgtcccacggcagggcggcgttaaattgggtatggaattgcagtagtggtttgttaaggatactcagcccgttgatccacattttggccggggagaaggtgtgcagccagaccaccagccccgcgcagcgatcgtcataattggcgtcacgacaaatggcggtaatctcatccggcgaggtgcccagcggttttaataccagtttacatggcagtttggcttcggtattcagcgcgttgaccacatgctcggcatgttgggtgacctggcgcagggtttctgcgccatacaaatgctggctgccaatcacaaaccatacttcataattatcaaaaatcgtcattgtcgtgtccttaatgagtcaggattgcctgattggccggggtcgttggcgccggcgcggcagtcggaagataatgttgttctgcgcttagcgcccactgctggtagcggcggtaaagccgttcgaagcgttgcgcctgttcagggcggggacgcagagtgcgttctaccgcgctcgccatgctttgctgggcggcaggaatatcggcatggactttcgcggcaacggcggcaaagatagcggcgcctaatgcgcaacattggtcggaagcgacgatctgcaacggacgattcagtacgtcgcagcagacctgcataatgacctgatttttacgggcgatgccgccaagcgccatcacgttattgaccgcgataccctgctcggtaaaacactcctgaatggcgcgcgcgccgaaggcggtcgaggcgaccagaccgccaaacagcgctggcgcgtcggtggcgagattgagatcggtaatgacgcctttcagacgctggttggcattgggtgtacggcgaccattgaaccagtcgagcaccaccggcaggtgatccagggacggatttttcgcccaggcgtcggtgagcgctggcaatagctgcttctggctggcgttaatctgggttttcagttccgggtgctgcgcggcaagttgttccagcggccagctcaacacgcggctaaaccaggcgtagatgtcgccgaaagcggactggcccgcttccagaccgataaagttcggcaccacgctgccgtcaacctgaccgcaaatgcctttcacggcgcgatccccgacgctctgtttatccgcaatcagaatgtcgcaggttgacgtgccgatgacttttaccagcgtattgggctgtgcgcccgcgccgaccgcgcccatgtgacagtcgaacgcgccgccggaaatcaccacgctttccggcaagccgaggcgctgcgcccattcggcgcacagggtgcccacgggcagatcggcggtgaaggtttcgctaaataacgggtagcgcagatgacggttaatgcacggatcgagttcatcaaagaagctcgcgggcggcagaccgccccagctttcatgccacagtgttttgtgcccagcgctgcagcggccacggcggatatcctgcgggcgagtggtgccggaaagcagcgccggcacccagtcacacagttcaatccacgagacggcggcctgcgcgacggcgctatcctggcgggtgacgtgcagaatcttcgcccagaaccattcgctggagtaaatgccgccaatatagcgggagtagtcgaccttacctggcttatggcacagacgagtgatttcgtcggcttcttccacggcggtgtgatctttccacagcacaaacatcgcattcgggttctcggcgaactccggacgcagcgccaggacgttaccgtcggcgtcaatcggcgctggcgtagaaccggtgctgtcaacgccaatgccaacgacatttgcgcgttgcgcggcgcttaattgtgccagaacggctttcagcgcggcctccattgactccatgtagtcgcgcggatgatgacggaactggttgttcgggccgtcgcaataacggccttcttgccagcgcagataccactctacgctggtggcgatctcgtcgccggtggcgcagtccactgccagagcgcgcactgaatcactgccaaaatcgaggccaattgcaattgccatcgtcttactccatccagaaaaacaggtatggagaaacagtagagagtcgcggcaaaaaccgtcaggcaggatccgctaatcttatggacaaaaatgctaatgctttgcaaagtgtgacgctgtgcaaatattcaatgtggacattccagccatagttatagacacttctgttacttaattttatcgcctgaactgtacgcttttgttacaaagcgcttttcacaagcggggttgatacgtgctttcatcaagcgcaaggtcttgcggagacggaagctctgtcgtcctggtcaatatggacaatttgtttcttctctgaacatcggggggtagagaaatcatggctgaaacgcaaaatgatccgctattgccgggatattcatttaatgcccatctggtcgccgggctgacgccaattgaagcgaatggatatctggatttttttatcgatcgtccgttgggcatgaagggatatattcttaacctgaccatccgcggagagggcgtcattaataataatggcgagcagtttgtctgtcggcctggcgatatattattgtttccgccgggcgagattcatcactatggacggcatccggatgccagcgggtggtatcaccagtgggtttatttccggcctcgcgcctactggcaggagtggctgacctggccgacaatctttgctcagacaggatttttccgcccggacgaggcgcgccagccgcatttcagcgaactgttcgggcagatcatcagcgccgggcaaggggaaggtcgctattctgagctactggcgatcaatctgctggagcagttgttgctcagacgtatggcggtaattaatgagtcgttgcatccgccgatggatagccgtgtgcgcgatgcctgccagtatatcagcgaccatctggcagacagtcattttgatatcgccagcgtcgcccagcatgtctgcctgtcgccctcccggttatcgcatctgttccgccagcagttaggcattagcgtattgagctggcgcgaagatcagcgtatcagccaggcgaaactcctgcttagcaccacgcgaatgccgatagcgaccgttgggcgcaatgttggatttgacgatcagctctatttttcgcgggtatttaaaaaatgcaccggggcaagtcctagcgagttcagggccagatgtgaataaaaagtgaatgatgtgtccacaaagatgtcataagccgtaactattcggataattgacggcttgacgaagggggacggggtaagcagaatccctgcttcatcacgctgacggacacactatgcaagcactgctggaacactttatcacccaatccactctgtattcgctcatcgccgtgttgctggtcgccttcctggaatcgctggcgctggtggggttgattttacccggcacggtactgatggcggggctgggcgcgcttatcggcagcggcgagctcaatttttggcatacctggctggtgggtattatcggctgtctgatgggcgactggatttcgttctggctggggtggcgctttaaaaagccgctacaccgctggtcttttatgaaaaagaacaagtcgctgctggataaaaccgaacatgcgctgcatcagcacagtatgttcacgatcctggtcggacgttttgtcggtccgacgaggccgctggtgccgatggtggcagggatgctggatcttcccgtagcgaaatttattgggccaaacttgattggctgtttgctgtggccgccgttttatttcctgccgggcattctggcgggagcggcaatcgatattccttccgatatgcagagcggagatttcaaatggctgctgctggcgacggcgttgctgctgtgggtcggaggctggctatgctggcggctgtggcgcagcggcaaagcggcagtcgatcgtttaaccgcgtatctcccccgcagccgtttgctgtatctggcgccgttgacgctcgggatcggcgtggtcgcgctggtggtgctggttcgccacccgctgatgccggtgtatatcgatattctgcgcaaagttgtgggttactaacgattcctttgccggatggcggcttcgccttatccggcctacaaaatatgggatttgatgcccaatagcgctgaggcgctggcttgaccgcttagtagctcgtctgttttgccttgccacgcaatgcgtccgtcggcgacgacgattgaccggggcgcaatccgcgccgcatcttccacgctgtgcgagaccatcaacagcgtgagctgtcgctcgcggcagatatcgctgaccaacgtcagcatctcctggcgcagcgcgggatcgagcgcggagaacggttcatccagcagcagcaccggctgttcacgtaccaggcagcgcgccagcgctacccgctgacgctgcccgccggacagttcgcccggtaaacgcgccatcagactctcaatgcccatctgacgtgcgatagcgtcccgtttttcccgctggctggcgttgagcgttaacccagggtttagccccagaccgatattttgctgcacattcaggtggctgaataaattattctcctgaaacagcattgagaccggacggcgtgagggcggcgtaagcgtatggtcttcgccggcaatcagtagcgtaccgctggcaggcgcaagaaaaccggcaattaaattcaacaacgtgcttttccccgcgccgctggggccaagaatcgccacctgctcgccgcgttctaccgccagcgtaaaacgcatcggcaaatgatggtaaagccaggtgatatcaatcagttttagcatgtcggcccggtagtttctctatgagggtaaataacgtaaaacagagcagcaacagtatcagcgcggtcaccgcgccgtcctggctgcggtaggagccgatctgctgatacagataaaacggcagcgtgcggaaattgtcattgccgaaaagcgcgacgacgccaaaatcaccgatagaaagtacgcaggcaaacgccagcgcctgcgccagcggacgtttcagcgcccgcagttccacgacctttaaccgcgaccagccttcaattcccaatgactggcacagcattccataacgggcggtaatatcgcgcattgggttttccaggacttttagcgcgtaggggattgccatcagcgcattggtgaaaatcacgatgccgtcggcggattccggtaagccaacgctgttattgagcagtaaaaagaagcctgtcgccagcacgatccccggcatcgcgaggatcaacattccgctgagttccagcgtttgtccggcgaatagttgctggcgttggtgtagctcgcggctactccacagcagcatcatggtcagcaccacacacagaacgcccgccgccagcgcaatgcgtagcgatgtccagacagcctgccacagaatgggttgcgccagcacttccggcaggctgcggttgacgccatcgaccaccacggcgaccagcggcggaagcagcaatagtagcgccagcacgattaataaggcgtccgtcagacggctgtggagacgatcgtcaggatcgcgccagccctgcgtcagcgtcatccccggcgcaatcgctttgctcaaccgttgacttagcagtaccagcgccaggcagcagaccatctggattaatgccagcatcgccgcgcgggcgggatcgtagtcataactgagcgcctgaaagatagccagttcgatagtggtggcctgcgggccgccgccgagcgacaggaccgttgcgaaactggcgaagcagagcataaaaatcagcgccgcgacgggcggaatttggcggcgcagccacggccattcgacaaaacggaaaaaatgccagccgcgcataccgagctgggcggcgagctggcgctgctcgccgggaatgctttccaacgattgcagcaacaaacggctcgccattggcagattaaaaaagacgtgcgccagtaaaatgccctgcaagccgtagggggagaatgtccactgaagccccagcatctgccacagcgaggccagccagccctgacgtccatacacgctaagaatgccgaacacggcaaccagtaccggcagaatcagcgtcatggcgcacagacgcagcagcgccagacgtccaggaaaacggcgtcgataaagcgcgcgggcgagaaaaaccgccgggaccacagacagcactgcggacagaaacgcctgccagaatgagaagcgcaccacatgccacagatagctatcccgccagagtgtcgaccacgcgcccgacggcgcgttcagccaaagcgccagaaaggccgccagcgagacggttatcatcagcgcggcggcgcacagccccggaatcagccagccgggaattaacggctgacggcgcgttgccattcgctaatccatgcctggcgttgtgctgccacttgttgcggcgtgaattccagcgttgtggcgggtttggccaatgattcaaaccctgcgggtaaggcgacgtccgctaccgggtacatccagttgccggtgggtatggcgttctgaaacgccggagaaaccataaatttgaggaatttctccgccagttccggctgcttactggcgacggtacgcgccgcgacttctacctgtaagtaatggccttcgctgaagttcgcggcggcgtaattgtccttcttctcttcaataatgtgatacgccggagaggtggtgtaactgagcaccaaatcgctttcacctttcagaaataaaccgtaggcctcgctccagcctttcgtcaccgtcaccgttttggccgccagtttttgccaggcctgcggcgcgttatcgccataaactttgcgcatccacagtaacagccccagccctggcgtactggtacgcggatcctgataaatcacccgccatttttgatcgctctcgaccagttctttcaggcttttcggcggatttttcagcttgcttttatcgtagacaaaggcgaaatagccgtaatcgaacggcacaaatgtgtcgtttttccagccgccgggcaccttgaccgcctcattcgccacgccgcttttggcaaagagtttagtttgcgtggccgcctccagcagattattgtccagccccaacaccacatcggctttgctgttcttcccctccatccgcaggcggttgagcagcgaaacgccatcctccagcgccaccagtttcagctcgcagttgcaatcggcttcaaacgcttttttcaccgccgggcctggcccccagtcggcggcgaacgagtcgtaggtatagacggtgagaacgggtttggcgaaagcaggcgccgcgcacaggagtaaaagcggaagatatttttttaacactttgcacctcagttaaagagtggcaaaggacttgagaggtagcctcaaatcccttcgccggcattatccggatcaggttcgacgggtattttctcagcgcgcgcatgagcgcggcaccccgttgagttcggcgttagtgtagtgattttgttgccgggcagcaatcaagagctggcgttaaggatctggcggcgcaaaccacgccgatttaaaatcaaaccagccgagggtattcatgcgcagcccgcgcatactgcgttgtccctggataatcagccagtggtggatcaacggcacaatcgctttgttggccagcagttgctggcaccagttcgccaggttcatctcgccagcgcgccactgcgcggcgtcgtcctgccagtcgcgcggaatgcagttctgcaagagcggtacttcgcacaggtgcgcgaacagcgagaaatccagcggcagcgtaaagttagcgctattgagccagatatcgctttcgatctcgccggcgtgccattgatcgtagtcgatctcctgaatatgcagatgcacctgatgttcagccagaagcgcgctcatgatacgggcgataacccggtgctcaatgtgttcgcgatagaaggtcagcgtgagggtttccagcccggcgggtttttcgcccgggcctggacgggcgtggtgccagcgcggtaaaagcccataggccgggaaccagagctgctgtagcggttcatcggcatgatagagtaaattggtgggggagaggacgtggcttacccattctctgacctgcggatgcgcgccgcgcggcgttctggcgtcgaatagcaggtaatagcacccctcttccagtcggctttctatcgctttttcaccgccttgtattggcccttccagcatcaagccgcaggccggttcttcactgatatccggcagtacccagacgttcacttcgtctatcaacgcccgatagccgaagtaatcatcaaaggcgagtatcttgagctggtttggcgtattacgccgcacggcataaggcccggtgccgatagggtggctggcgaaattagccagcgtttcccactcccgcggcaaaatcatcgccgggacctggcccagcagccacggcaaccagcgatccggctgggaaagatgaatatccagcgtccacgcggtaggggagtctatctttgtgatgtgcgagtaaagcggaagcgtattgatacgcgtcagcgaggcgatgacatcttccatctccagctcgcggccatgatgaaaatgaatgccggggcgcaggtagaagcgccacagtaaaggggaaatttgctgccagtggtgcgcaatgtccgcttccagttccccgttttcctcatttacccgcgtgagcgaactgaaaatttgccgggcaatatgagtttccgagcgacgtaatgcggttcccggcaggagattgtgcatcggacgatagtaaagaacccgcagaatatgccgcccctggcggaagctgcgtcccagatgggaaatcagcatttgcctgacagcgcttttatcgccgaccagttgtaccagttgatcgattcgatcttgttccagcaggtcttccgcccgctgctgttgcagcgccagtccggtatacaggaacgtcagacgcgaacgctttccgcgtccgacctcggcttcccatgttagccaaccgcgcgcctgcatcgtatttagcagcgtacgcatatggcgacgcgaacagttcagcagatccgccagctcattaagcgtggtgtcttgcgttttaccgtcacaacattgccagagacggataaattgttgttgcaggcgacctgagggcataaaaggggaactccgatgaaaaactcagcaattttattatccctatattaggccaataatatctttcgatgaagcaagaggaagaggtcactatgcgccagttctggttgagatattttgccgcgacggaaaaaacgtcctggctggcttgcctgagcgcgccgcagcgcttaaaaatgctcgcggaactgatgcagtgggaggcgaccgattgaagccaattgcagacatcatgtgtgactgagtattggtgtaggcgatagcctaaaatcacccgccagcagataatatctgctggcttttttatttcggctgtttctggatgacgacgatgggacggcgtctcaacgggatttctgcggcggtttctgtggtcacgcgggtgatgaccgggcgagtaaaagacgtataaaaaatgccggaatatccccggcatgagcgactgatgagtaaccaggcgcttgatggcgctacgcttatcaggcctacagaatatagtggcaacctggtgatattgcataccctgtaggcccggtaaggcgtgaaaggttaccgcataaatgccggttgtttattttcgtactcggcaatcgcgtcttcgtgctgcagcgtcagcccgatgctgtccagaccgttcaacatgcagtggcggcggaagtcgtcgattttaaaactgtaggtcttatcgcctgctttcaccacctgtgcttccagatccacttcaaatttaatgcccggattggctttcaccagcgtaaacagctcatcgacctgttcgtcgcttaacttcaccggcagcagttggttattgaaactgttgccgtagaagatgtcggcgaagcttggcgcgatcaccactttaaaaccgtaatcggtcaacgcccacggcgcgtgttcgcgtgaagagccgcagccaaagttttcccgcgccaacagtatcgacgcgccttgatattccggaaagttcaacacgaattccggatttggctgttggcccttttcgtccaggaaacgccagtcgttaaacagatgggcgccaaaaccggtgcgcgtaaccttctgcaaaaactgtttagggataattgcatcggtatcgacgttggcggcatccagtgggacaaccaggccggtatgctgggtaaatttctctgccatggtagtttccttatttgatgctgcgaatatcggcgaagtggccggtaacggcggcagcggcggccatcgccgggctgactaaatgcgtgcgacccccgcggccctgacgaccttcaaagttacggttgctggtggaggcgcagcgctcgcccgggttcaggcggtcattattcatggccaggcacatggaacagcctggtaagcgccattcaaatcctgcttcgataaagatcttgtccagaccttccgcttccgcctgcgctttcaccggacctgaacccggcaccaccagcgcctgcacgccaggcgcaactttgcgccctttggcgacttccgccgccgcgcgcaaatcttcaatacgcgaattggtacaagagccgataaagactttatcaatagcaacgtctgttaacggtacgcccggctgtaagcccatataagccagcgctttttcggcgctggcgcgctcaaccggatcgctaaaagaggcgggatcggggatgatgtcggtgacggaaatcacctggcccggattagtgccccaggtcacctgcggcgcgatctcttctgctcgcagggtgacgacagtatcaaaggtcgcgccgtcatcggttttcagcgttttccagtactcgacggcttcgtcaaaatcgcggcccttcggcgcgtgcaaacgcccttttacgtagttgaaagtggtttcatccggggcgaccagaccggctttggcgcccatctcaatcgccatattgcacagcgtcatgcggccttccatactcagcgcgcggatagcgtcgccgcaaaattcaaccacgtgtccggtgccgccggcgctaccagttttaccgatgatcgccagcacgatgtctttggcggtaatgcccggtgcggcgttgcccgtgacttcaatcttcatggttttagcgcgcccctgtttcagggtttgcgtcgccagtacatgttctacctcagaagtgccgatgccgaaggccaacgcgccaaacgcgccgtgggtagcggtgtgggagtcgccgcagacgatggtcatacccggcagggtaacgccctgttccggccccatcacatggacgatgccctgatatgggtgattcaggtcatacagctcgacgccgaactcgttacagttcttaatcagctcttgcatctggatacgcgccatttcaccagaagcattaatgtctttagtctgcgtcgagacgttgtgatccatcgtggcgaaggttttccccggctgacgtaccggacgatggtgcgcgcgcagaccgtcaaacgcctgcggcgaggtcacttcgtgtaccaggtggcgatcgatgtacagcagcggcgtttcgtttggcgcctcaaagaccacgtgggcatcaaataatttttcgtataacgttttggccatgattacaccccttctgcgacatagcgggcgataatatcgcccatctcatcggtactgactgcggcagcgcccctggctaaatcgctggtgcgaaccccctcttctaatgcgcgattgatcgcctgttcaatggccgttgccgcctcatcggcatccaggctgtagcgcagcagcagcgccagcgacaggatctgcgcaattgggttggcgatatttttcccagcgatatccggcgcggagccgccagccggttcatacaggccaaactcttgctcgttcaggctggcggagggcaacatccccattgagccggtgatcatggcgcattcgtcggacagaatgtcgccgaacaggttagagcacagcaggacgtcaaactgcgacgggtctttaatcaactgcatggtggcgttatcgatatacatgtgcgcgagttccacatcgggatacgctttcgcgacatcattgacgatctcacgccacaggatagagctttgcagtacgttggctttatctatagaggtgactttacggcggcgtttacgcgccgattcaaaggcgatacgggcaatgcgctcgatctcaaagcggtgataaacttcggtatcaaaggctttttcgtactgaccgctgccttcacggccttttggctgtccgaaatagatcccgccggtcagctcgcgcacgcacaggatatcgaaaccgttagcggcgatatcggcgcgcaacgggcaaaatgcttccagtccctgatacagtttcgccggacgcaggttactgaataatttgaaatgtttgcgcagcggcagcagggcgccgcgctccggctggctttccgggggcaaattttcccatttcgggccgccgacggagccaaacagaatggcatccgcctgctcacacccttcaacggtggctttcggcagtggatgaccatgattgtcgatagcaataccgccgacgtcatagcggctggtggtgatacgcatatcaaaacggctgcgtaccgcatccataactttcagggcttgcgccatgacttccgggccgataccgtcgcccggcagtacggcaatatgatagttcttcgacattacacggtttccttgttgttctctttattttgagctttgcgttgcaattctttttcaacttcggcggcgcgccagatattgttcagtacgtgtaccatcgctttggcggaggattcgacgatatccgtcgccagcccgacgccgtggaagcggcgaccatgatggttcacgacgatatcgacctgacccagcgcgtctttgccctggcctttggcgttcaggtcgtatttaaccaactcaacgtcgtagccagtgatgcggttaatcgcctgatagatggcgtcgaccgggccgttgccgttcgccgcctcggccttgatctcttcaccacaggccagcttcacggaagcggtggcgatatcgctggagccggactgcacgctgaagtaatccagacggaaatgctctggttcttcttgctgtttattaataaacgccagcgcttccaggtcatagtcgaacacctggccttttttgtccgccagcttcaggaacgcgtcgtacaggtggcccatgttgtagtctgtgtccttgtaacccatctcttccatgcgatgtttcacggcggcacggccagagcgggaggtcaggttcagctgtatctggttcagaccgatggactctggcgtcatgatttcatagttttcgcggttcttgaggacgccatcctggtggatgccggaagagtgggcaaaagcgccgctgccaacaatcgctttgttggccgggatcggcatgttacagatctggctgacggtctggctggtgcgccagatttcgtggtgattgatgttggtgtgtacgtttatgatgtctttgcgcactttaatcgccatgatcacctcttccagcgcgcagttaccggcacgttctccgataccgttcatcgcgccttcaacttgacgcgcgcccgcatgtactgccgccagcgagttgcctaccgctatccctaaatcgtcgtgggtatgaacggagatgatagctttgtcgatattggggacacgttcatacagaccggaaatgattcccgcgaactcaaacggcatggtatagcccacggtatcgggaatattgatggttctcgcgccggcgtttatagcggcttccaccacgcgcgccagatcgtcaacaggcgtccggccagcatcctcgcaggagaactccacgtcatcagtgtaattacgcgcccgcttaaccatgtataccgcgcgttcgatgacctcatccagcgtgctgcgcagcttggtggcgatgtgcattggcgaggtggcgataaaagtatggatacgaaacgcgtcggcgaccttcagcgcctgtgccgcaacgtcgatgtctttttctacacaacgcgccagggcgcaaacgcggctgtttttgatggtgcgggcgatggtttggacggattcaaaatcacccggagaagagaccgggaagcccacttccatgacatcgacacccatgcgctcaagggccagggcaatctgcagcttctctttcgcgctcaggctggcctgtaacgcttgttcgccgtcgcgtaaggtcgtatcaaaaataatgacttgctggctcatgatgtggtccttgtctccaggggcgccttgcgtcaggcataaaaaaacccgcacaacggcgcgggttttgtttgacttcgagctgacttaatgttgaatgccgcccaccggtctaccgcgcacaataaatgcgttgagtagtagtagcccagtgaaacgaacgatatatgacattaattctagctccagcgaatgcgttatgcttttagtggtactggatatgccgtttaatgtcaactctattttctgtcgccattgcattttgttgacgatatccggatacgtactttagctaattgtgctgggctgcgcgtccaataaaggataaaagaacgagtggacattcatacttttcattgtttgaaatatttaggcatttttgtttgcaaattggttaggggaatggcctgttaaaggtatgctaaaggtttggtttatctttttgatttgttttatattttaacaaataaccttgtttgcttaatggataaggataaagttattgataaattaatgttaactttttagctattaataatataaacatttaattgaaacttaaatgatcattcacttggtgtatgattgtgtattcgccatagttatggttatattgcttgcgtaatttaaacattatgaatcgcaatggtgtgactcaggacatattacgcttgcgctggcattctatttgtctctgtcagcgtctttatgttttccgaattttaacgctttccctttttcttattttatatgcatggtaaatcatattttcaggaattatttctgccttcagccagaaaaagggagttaagcgtgacagtggagttaaatatgccagaggtcaaaaccgaaaagccgcatcttttagatatgggcaaaccacagcttcgcatggttgatttgaacctattgaccgtgttcgatgcggtaatgcaagagcagaatattacgcgcgccgcccacacgctgggaatgtcgcagcctgcggtcagtaacgccgtagcgcgtctgaaggttatgtttaatgacgaactttttgttcgatatggacgaggaattcagccgactgcccgtgcatttcagttatttggttcagtccgtcaggcgttgcaattggtgcaaaatgaattgccgggatcggggtttgagccgaccagcagcgaacgtgtattcaatctttgcgtgtgcagtccgctggataatatcctgacgtcacagatttataatcgtgtagaaaaaattgcgccaaatattcatgtcgtttttaaagcgtcgttgaatcagaatactgagcatcagttacgctatcaggaaaccgagttcgttattagttatgaagaattccgtcgtcctgagtttaccagcgtaccgctatttaaagatgaaatggttttagtcgccagccgaaaacacccgcgtattagcggcccgctactggaaggcgatgtttataatgaacaacatgcggttgtttctctcgatcgttatgcgtcatttagtcggccgtggtatgacacgccggataaacagtcgagcgtggcttatcagggcatggcgcttatcagcgttctgaacgtggtttcgcagacgcatttggtcgctattgccccgcgctggctggcggaagagtttgcggagtcgctggagctgcaaatactgccgttgcctttaaaactgaatagccggacatgctacctttcctggcatgaagcggctgggcgtgataaagggcatcaatggatggaagatttattagtctctgtttgtaagcgataaaaccgggcagaataaatcagaaacaaattctggtttattctgctttttagcgtatgtcaaaaattttatgctgaattaacggtgagcgattcttttcgtcgctgtgaaaaatagatgaattgctgtaagtctgcatttataagcgattatttattacctggtgtgattcagacggagtatttctccatttcttctcttcttgcctcctgattattctaaccttccccatctttacgtcattccacccaattgccaggcgtgatagcgagcggttaaggtgtccgtcaaaccgtaatgacaggtataaagtggaggcaagccgtggagatgttgtctggagccgagatggtcgtccgatcgcttatcgatcaaggcgtaaagcaggtgttcggctatcctggaggcgcagtgcttgatatttatgatgcgctacataccgttggagggatcgatcatgtgctggtgcgtcatgagcaggccgcggtgcatatggcggatggcctggcgcgagccactggcgacgttggcgtggtgctggtgacttccggaccgggagcgaccaatgcgattacagggattgctacggcctatatggattccattccgctggtgattctttccggccaggtcgccacctcattgattggctatgatgcctttcaggagtgcgacatggtggggatttcccgaccggtggtcaaacatagcttcctggtcaaacagacggaagatattcccctggtgcttaaaaaggccttctggctggcggcaagcggacgtcctgggccggtggtcgtggatctgccgaaagatattttgaatccggcgaaaaaaatgccgtatgtctggccggaaacggtcagtatgcgctcttacaatcccacaacatcaggacataaaggacaaattaagcgtgccttgcaaacgctggcgtcggcaaaaaagccggtggtctatgttgggggaggggcgataagcgcggcctgctatgcgccgctgcgccacatcattgaaacctttaacctgccggtggtctcttcattaatgggactgggcgcgtttcctgctactcatcgccagtcgttaggaatgctgggaatgcatggcacttatgaagccaatatgaccatgcataacgccgacgtgattttcgctgttggcgtacgatttgacgaccgcacgacgaataatctcgctaaatattgtccgaacgcgacggtattacacatcgacattgacccgacgtccatatccaaaacggttaacgctgatatcccggtggtgggcgatgcacgcctggtactggaacaaatgctggagctactggcgcaggatgcgccgtctcagccgcaggatgatattcgcgactggtggcagcagatagagagctggcgcgcccgtcagtgcctgaaatatgacgcggaaagcgaaagcattaaaccccaggcggtgattgaaactctctggcgtctgacgaagggtgatgcgtacgtgacgtccgatgtaggacaacaccagatgtttgccgccctctactacccgttcgataagccacgtcgctggattaactctggcgggctcggcacgatggggtttggcctaccggctgcactgggcgttaaaatggccctgccgaaagaaatggtggtctgcgtgaccggcgatggcagtatacagatgaacattcaggagctgtcgacagccttacagtatgaactgccggtactggttctgaacctgaacaaccgttacctggggatggtgaaacagtggcaggatatgatctattccggtcgccattctcagtcttatatgcagtcgttaccggattttgtgcgcctggcggaagcatatggccatgtcgggctgcagattaaccgtccggatgagctggaaagtaaactcagcgaagcccttgagcatgtgcgtaataaccgactggtgttcgtcgatgtcaccgttgatggcagcgagcatgtctatccgatgcagattcgcgggggcgggatggacgaaatgtggttaagcaaaacggagaggacctgatgatgcgccggattttatcggtattactggaaaacgaatctggggcgttatcgcgggttatcggcctcttttcgcaacgcggatataatattgaaagcctgaccgttgcgccgacagacgatccgacgttgtcgcgcatgactatccagacggtaggcgatgaaaaagtgcttgagcaaattgaaaagcaactgcacaagctggttgatgtgctgcgcgtcagcgagctgggacagggagcgcacgttgagcgggaaatcatgctggtgaaaatccaggccagcggctacggacgggaagaggtgaagcgtaatacggaaattttccgtggtcagattattgacgttacgccaacgttgtataccgttcaactggcgggcaccagcgataaactggatgcttttctggcctcgctgcgcgatgtggcgaaaattgttgaagtggcgcgttcaggcgtcgtcgggctttcgcgcggcgataaggttatgcgctgagcagattcgccggatgacgacgcgcttgcgttttatccggtctacaggctgatatctggcccaggtccgataagcgtagcgccatcaggcaggtttgccggatatcagccaacaggaattatcgcccaacccaatatcatcggttgggcttttttttgcgaaatccgtggtaacccggaataaaagcggttgccggagtgatcaaactgcgcttagatgttaacgattttaacccatgccgacataaaggttatggtttgtacaatttacacaaggggcaattgtgaaactggatgaaatcgctcggctggccggtgtctcgcgcacaactgcaagctacgttataaacggtaaagcaaagcaataccgcgtgagcgacaaaaccgtagaaaaagtcatggcggtagtgcgtgagcacaattaccatcctaacgctgtggctgccgggctgcgtgctggacgcacacgttccattggtctggtgatcccggaccttgaaaacacgagctacacccgtatcgcaaactatcttgagcgccaggcacgccagcgtggctaccaactgctgatcgcctgttctgaagatcagccggataacgaaatgcgctgcattgagcaccttttgcaacgccaggtggatgcaatcattgtttcaacttcgttaccgccggagcatcccttctatcagcgctgggccaacgatccgttccccatcgtcgcgctcgaccgcgcgctggatcgcgaacatttcaccagcgtggtcggcgccgatcaggatgatgccgagatgttggcggaagagctgcgtaaattcccggcggaaacggtgctttatttgggcgcgctgccggagttgtccgtcagtttcctgcgcgagcaggggttccgcaccgcatggaaagacgatccgcgggaggtgaatttcttatatgccaacagctatgagcgcgaagccgccgcgcagctgtttgagaaatggctggaaacgcatcctatgccgcaggcgctctttacgacatcattcgcgctattacagggcgtgatggacgttacgctgcggcgcgatggaaaactgccttcggatttagcgattgcgacctttggcgatcatgagctgctggattttctgcaatgcccggtactggcggtggcgcagcgtcatcgtgatgtcgcggaacgcgtgctggagattgtgctggcaagtcttgatgaaccgcgtaaaccgaaacccggcttaacgcgtattcggcgaaacctgtatcgtcgcggcattctgagccgtagctaaaggaccggcggtaaaagactctctcttctgccgccgtcaaacaaatgcgtatcagtaaaaatatcccttaaataattaagattattccttaaaattatccgaaaattcttttttattacctttcttttgtccgaaatcgtccatattccactaattaagacgtaacgagtcttttcctttgtattgttttgttacaagcaggcaagaaatcgtcgaattaacagccactttttgtctttggcgcgacagtcgcttgtaggcgctggtatagcaggcgccgcacacgttaaacaggcactgttaacacggtgcaatatgtcctaaaatgccgctcgcgtcgcaaactgacactttatatttttctcggattatattgagtccgttttaaacggcggtgggtctttggtttttttcttacaaatattcataacgttaatttggcttgcgcgctgggcggaaattaatcaacgcagatattcgccgtaaacattggcttttttacttcggtaagcgttgtgacttgcttgacaagcttttcctccgctccgtaaactccttcgagtgggaatttgtgggataaagtggtaagaaggggtgagactggcatgttccggggggcaacgttagtcaatctcgacagtaaagggcgcctgaccgtgccgacccgttatcgggagcaactgatcgagagcgctaccggtcaaatagtatgtaccattgacatccatcacccatgcctgctgctttaccccctgcctgaatgggaaattattgagcaaaagttatctcgtctgtcgagcatgaacccggtagaacgtcgcgtacagcgtttactgttgggccatgccagtgaatgtcagatggatggtgcaggtcgattactgatcgcgccagttctgcggcaacatgccggactgacgaaagaagtgatgctggttggacagttcaacaaatttgagctgtgggatgaaacgacctggtatcaacaggtcaaggaagatatcgacgctgaacagtcagctaccgaaacgttatcggagcggctgcaggacttgtctctataagatgatggaaaattttaaacacactacggtactgttggatgaagccgttaatgggctgaatattcgtccggatggtatctatattgatggcacatttggtcgcggcggccactcgcgcctgatcctctcgcaactgggcgaagaggggcgcttgctggcgatcgatcgcgatccgcaggcgatcgccgttgcgcagaccattaatgatcctcgcttctccatcattcatggacctttttccgcgctggctgattatgtcgccgagcgcgagcttaccggcaagattgacgggatccttctcgatcttggcgtctcttctccgcagcttgacgatgcggagcgcggtttttcatttatgcgcgacggtccgctggatatgcgaatggacccgacgcgcggccagtctgccgccgagtggttacaaacggcggaggaggcggatatcgcctgggtgctgaaaacattcggcgaggagcgttttgccaaacgtattgctcacgccattgttgagcgcaatcgcgaacagccgatgacccgcaccaaagagctggcggaagtggttgcggcggcgaccccggtaaaagacaaattcaaacatcccgcgacccgtaccttccaggcggtgcgcatctgggtaaacagtgaactggaggagatagagcaggcgctaaaaagctcgctcagcgtactggcctcaggcgggcggctttcaatcatcagtttccactcgctggaagaccgtattgtgaaacgctttatgcgtgagcaaagccgcggtccgcaggtaccggcgggattaccgatgacggaagcgcagctcaaaaaactgggcggtcgtgagttacgagcgttaggcaagttgatgccgggtgaaaaagaggtagctgaaaatcctcgggcccgtagttcagttctgcgtatcgcagagaggacgaacgcatgatcagcagagtgacagaagccctaagcaaagttaagggatcgataggaagcaacgagcgccatgccttgcctggcgtgatcggtgacgatcttttgcggttcgggaagctgccactctgcttgttcatttgcatcattttaacggcggtgacggtggtcacgacggcgcaccatactcgtttactcaccgctcagcgtgaacaactggttctggagcgcgatgcattggacattgaatggcgcaacctgatccttgaagaaaatgcgctcggcgatcacagccgggtagagcggatcgcaacggaaaagctgcaaatgcagcatgttgatccgtcccaagaaaatatcgtagtgcaaaaataaggataaacgcgacgcatgaaagcagcggcaaaaacgcaaaaatcgaagcgccaggaagaacagaccaacttcatcagttggcgttttgcgttgctgtgcggctgtattttactggcgctggtttttttacttggacgcgcggcgtggctacagattatcgccccggatatgctggtgcgtcagggcgatatgcgttcgctgcgtgttcaggaagtctccacctcacgcggtatgattaccgaccgttccgggcgtccactggcggtcagcgtaccggttaaggcgatctgggccgacccgaaagaagttcatgacgccggcggcatcagcgtcggcgatcgctggaaagcgctttctactgcgctcaatattccgctcgatcagctctccgcccgtatcaacgccaacccgaaagggcgttttatttatctggcgcgccaggtaaatcctgacatggcggactacatcaaaaaactcaaactgccggggattcatttgcgtgaagaatcacgccgctactacccgtcaggagaagtaaccgctcacctcatcggttttaccaacgttgacagtcaggggattgaaggcgttgaaaagagctttgataagtggcttaccggtcagcctggcgagcgaatcgtgcgtaaagaccgctatggccgcgtgattgaggatatctcctccactgacagtcaggcagcgcacaacctggcgttaagcattgatgaacgcttacaggcgctggtttaccgcgaactgaacaacgcggtggcgtttaacaaggcggaatccggtagcgcggtgctagtcgatgtcaataccggtgaagtactggcgatggcgaatagcccttcctataaccccaacaaccttgccggtacgccgaaagacgcgatgcgtaaccgtaccatcaccgacgtgtttgaaccgggttctacggttaagccgatggtggtgatgactgcgcttcagcgcggtatcgtcaacgaaaatacggtgttgaataccgttccataccgaattaacggccacgaaattaaagacgtggcgcgctacagcgaattaaccctgactggggttctacagaagtcgagtaacgtcggtgtatccaaactggcgttagcgatgccgtcctcagcgttagtagatacttactcacgttttgggctaggaaaggcgaccaatttggggttggtcggagaacgcagtggcttatatcctcaaaaacaacggtggtccgacatagagagggccaccttctctttcggctacgggctaatggtaacgccgttacagttagcgcgagtttatgcaacgatcggcagctatggcatttatcgcccgctgtcgattaccaaagttgatccgcctgtacccggcgaacgcatcttccctgaatccaccgtacgcaccgtggtgcatatgatggaaagcgtggcgctgccgggcggcggcggcgtgaaggcggcaattaaaggctaccgtatcgcgattaaaaccggtacggcgaaaaaagtggggccggacggtcgctacatcaacaaatacattgcttacaccgcaggcgtcgcgcctgcgagtcagccgcgcttcgcgctggtggttgtcatcaacgatccgcaggcgggtaaatactacggcggcgccgtttccgcgccggtatttggtgccatcatgggcggcgttctgcgcaccatgaacatcgaaccggacgcgctggcaacgggcgaaaaaaatgaattcgtaattaatcaaggcgagggaacaggtggcagatcgtaatttgcgcgaccttcttgctccgtgggtggctggactacccgcgcgagaactgcgagagatgacgctcgacagccgtgtggctgcggcgggcgatctctttgtggcagtggtgggtcatcaggcggacgggcgtcgttatatcccgcaggcgatagcgcaaggcgtagctgccattattgcagaggcgaaagacgaggcgagtgacggtgagattcgcgaaatgcacggcgtaccagtcgtctatctcagccagctcaatgagcgtttatctgcgctggcgggccgcttttaccatgagccatctgaaaacatgcgtctggtggcggtgaccggcaccaatggcaagaccaccaccacccaactactggcgcagtggagccagttgctcggcgaaaccagcgcagtgatggggacggtaggtaacggactgttgggtaaagtgatcccgacggagaacacaaccggttccgcagtggatgttcagcatgtgctggccagtctggttgcgcagggcgcgaccttcggcgctatggaagtctcttctcacggcctggtgcagcatcgcgtggcggcgctgaaatttgccgcctccgtgtttactaatttgagccgcgaccatctcgactatcatggcgatatggcgcattacgaggcggcaaaatggatgctttattccacccaccatcacggtcaggcaatcgtcaacgccgatgatgaagttggacgccgctggctggcgtcgctacccgatgcggtcgcggtttcaatggaagggcatatcaaccctaactgtcacggtcgttggctgaaagcggaggcggtggagtaccacgaccgcggagtgacgattcgttttgcttcaagctggggtgaaggcgaaatcgaaagctgcctgatgggcgcgtttaacgtcagcaacttactgctggcattggcgacgctgctggcgctgggctatccgttaacggatttgctgaaaaccgccgcgcgtttgcagccggtttgcgggcgtatggaagtgttcactgcgccaggcaaaccgacggtggtggtggattacgcgcacacgccggatgcgctggaaaaagcattgcaggcggcgcgcctgcactgcgccggaaaattgtggtgcgtctttggctgtggcggggatcgtgacaaaggtaagcgcccactcatgggggccattgccgaagaattcgcggatatcgtcgtggtgactgacgataacccgcgtaccgaggagccgcgcgccattatcaacgatattctggccggaatgctggacgccgggcaggtcagggtaatggaaggccgcgctgaggcggtaaccaatgccattatgcaggcaaaagacaatgacgtcgtgctgattgcaggtaaagggcacgaggattaccagattgtcggcacgcagcgtcttgattattcagaccgcgtgaccgcagcgcgtttgctgggggtgatcgcatgattagcgtaacgctcagcaaaattgccgatgtccttggcgccgaacaccgcggggcggatctcacgctcgatacggtcattaccgacacacggaaagtgacgccgggatgcctgttcgtggcgctgaaaggggaacgctttgatgcgcatgattttgctgataaagcaaaagcgaacggcgctggcgccctgctggtcagtcgtcctctggatatcgatcttccgcaggtgattgtaaaagacacgcgtcaggcatttggccaactggccgcctgggtacgtatgcaggtaccggcgcgggtggtggcgttaaccggttcgtccggcaaaacctcggtcaaagagatgaccgccgcgattcttagccagtgcggaaatactttgtataccgcaagcaattttaacaacgacatcggcgtgccgataacgctgctgcgcttaaaccatgattatgactatgcggtgatcgagttaggcgctaatcaccagggagaaatcgcctggaccgttagcctgacgcgcccggaagcggcgctggtcaataacctggcggcggcgcatctggaaggtttcggctcgctggccggcgtggcgaaagcgaaaggcgaaatctataccggtttgcctgagaacggtatcgcgattatgaatgccgataataatgactggctgaactggcaaagcattattggcgatcgtcaggtgtggcgcttttcgccgaatgcggcaaacagcgactttaccgctgcgaatatccacgtgacgtcacacggtaccgaatttaccctgcaaacgccgatgggcagcattgatgtgctgctgccgttgccggggcggcacaatattgccaacgcgctggcggccgctgctttatcaatggcggtgggggcgacgctggcggcggttaaagcagggctggcggcgttaaaagccgtacccgggcgtctgttcccgattcaactaagtgaaaaccaactggtactggatgacgcttataacgccaacgtcggttcgatgaccgccgcagtgcaggtcctttctgaaatgcccggctaccgcgtgctggtggtaggcgatatggccgagctgggcgcagaaagcgaagcgtgccacctccaggttggcgaggccgcaaaagcggcgggtattgatcgcgtgttaagcaccggaaaactcagtcaggttatcagccacgccagcggcgtcggcgaacattttgccgataaagccgcgctcattgcgcgtttacacgctctgcttcaggagcaaccgatgatgactattttagtgaaaggatcacgcagcgccgcgatggaagatgtggttcatgcgttacaggagaaaggttcatgttagtttggctggccgagcatttggtcaaatattattccggctttaacgtcttttcttatctgacgtttcgcgccatcgtcagcctgttgaccgcgctgttcatctctttatggatgggcccgcgtatgatcgctcgtctgcaaaaactctcttttggccaggtggtacgtaacgatggcccggaatcgcacttcagtaaacgcggtacgccgacgatgggcggcatcatgatcctgacggcgattgtgatttccgttctgttatgggcttacccgtctaacccgtacgtctggtgcgtgctggtggtattgatcggctacggcattatcggttttgtcgatgactaccgcaaagtggtgcggaaagataccaaagggctgattgcgcgctggaaatatttctggatgtcggttatcgcgctcggcgtggcctttgcgctttatctcgtcgggaaagacacgcccgcgacccaactggtggtgccgttctttaaagatgttatgccgcaattggggctgttttacattctgctgtcctactttgtcatcgtcggtacgggtaacgccgtaaacctgaccgacgggcttgatggtctggcgattatgccgactgtcttcgttgccgccggctttgcgctggtggcttgggcgaccgggaacatgaacttcgccaattacctgcatattccgtatttacgccatgcgggcgagctggtgattgtctgtacggcgattgtcggcgcgggattaggattcttgtggtttaacacctatccggcgcaggtttttatgggcgatgtcggatcgctggcgttgggcggcgcgttgggcattatcgccgtgctgctgcgtcaggaatttctgctggtgatcatgggcggcgtctttgtggtggaaactctgtcggtcatcctgcaggtgggttcctttaaactacgcggacagcgtattttccgtatggcgcctatccatcaccactatgaactgaaaggctggccggaaccgcgcgtgattgtgcgcttctggattatttcgctgatgctggtgctgattggcctggcaacgctgaaggtacgttaatcatggctgattaccaggacaaaaacgtcgtcattatcggtctgggcttaaccggactctcttgcgtggacttttttctcgcccgcggcgtgacgccgcgggtgatggatactcgcgtgacgccgccgggtctggataagctgccgcaagaggttgagcgtcacgttggcggcctgaacgacgagtggctcttagcggcggatttaatcgtcgccagccctggtattgctctggcgcatccctctcttagcgctgccgccagcgctggagtggaaattgtcggcgatatcgaactgttttgccgcgaagcgcaagcgccgattgtggccatcaccggctcgaacggcaaaagcaccgtgaccaccttagtgggcgagatggcgaaggcggcgggcgtcaatgtcggcgttggcggcaatatcggtcttccggcgctgatgctgctggatgccgatcgcgaattgtacgtgctggaattatccagtttccaattggaaactacctcaagtttgcaagcggcggcggcaacggtgctcaacgtcactgaagatcatatggaccggtatccgtttggtttgcaacagtaccgggcggcgaaactgcgcgtctacgagaaggcgaaagtgtgcgtagtgaatgccgatgacgcgttgacgatgccggtacgcggggccgatgagcgctgcgtcagctttggcgtcaatatgggtgattatcaccttaatcgtcagcagggcgaaacctggctacgagtcaaaggtgagaaggtgctgaacgtgaaagagatgaagctttccggtcagcataactataccaatgcgttagcggcgctggcgctggcggatgccgtaggtctgccgcgcgccagcagtttgaaggcgttgacgacatttaccggtctggcgcatcgcttccagctggcgttggagcataacggcgttcgttggatcaacgactcgaaagcgaccaatgtcggcagtaccgaagcggcgctaaacggtttgcatgtggacggtacgctgcatctgctgctgggcggcgacggtaagtcggcagacttttctccgctggcgcgctatctgaccggcgatcgtatccgcctgtattgctttgggcgcgatggcgcgcagcttgccgcactgcgtccggaaatcgcccaacagactgagacgatggaagaggcgatgcgtttgctggcgccgcacgttcagccgggtgatatggtgctgttgtcgcccgcctgcgccagcctcgatcagtttaaaaattttgagcaacggggcgatgtctttacccgtctggcgaaggagttaggttgatgcgtttatctctcccccgtctgagaatgccgcgcgtaccaggctttggcctcctggcctggctgtttgcggcgcttaaaggctgggtgatggcttcgcgcgataaagacgccgacagtctgatcatgtatgaccgcacgctgctatggctgaccttcgggctggcggcgattggttttgtcatggtgacgtcggcctccatgccagtcgggcagcgcctggcgaacgatccgtttttgtttgccaaacgtgatgcgctctatatcttcctggcattttgtctggcgatggtcacgctacgtttgcccatgaccttctggcaaaaatacagcacgacgatgctgattgcgtcgatcattatgctgcttatcgtgctggtcgtcgggagctcggttaacggggcgtcgcgctggattgcgctggggccgctgcgtattcagcctgcggagtttaccaagctgtcgctgttctgctacctcgcgaactatctggtgcgtaaggttgatgaagtgcgaaataacctgcgcggctttttaaaaccaatgggcgtgattctggtgctggcggtgttactgctggcacagcctgacctcgggacggtggtcgtactgtttgtcaccacgctggcgatgctgtttcttgccggggcgaaattatggcagttcatcgccattatcgggatgggcatctcggcggtgattctgttaatcctcgccgaaccgtatcgtattcgccgcgttacctcgttctggaacccctgggaagatccgttcggcagcggttatcagctgacgcagtcgctgatggcttttggtcgcggtgagatatgggggcaagggctggggaattcggtgcagaaactggagtatttgccggaggcgcacaccgatttcatcttcgccattattggggaagaactgggttatatcggtgtggtattggcgcttttaatggtatttttcgtcgcttttcgcgcgatgtcgattggccgtaaggcattggagattgaccaccgtttttccggatttttagcgtgttctatcggtatctggtttagttttcaggcgctggtaaacgttggcgcggccgcggggatgctgccgaccaaaggtcttacgctgccgctgatcagttatggcgggtcgagtctgttgattatgtcgacggccattatgtttttattacgtattgattatgaaacgcgtctggaaaaagcgcaggcgtttacacgaggttctcgatgagtggtcaaccgaagcggttaatggtgatggcgggcggtaccggcgggcacgtgttccccggactggccgttgcgcatcatttaatggcccagggctggcaggttcgctggctgggtacctccgatcgtatggaagcggatttagtgccgaagcatggcatcgatattgactttattcggatctccggtctgcgcggtaaaggcgtaaaagcgcttctggcggcgccgctgcggatttttaacgcctggcggcaggcgcgggcgatcatgaagcggtttaagccggatgtcgtgctgggaatgggcggttatgtttccggccccggcggtcttgccgcctggtcattgggtattccggtcgttttgcatgagcaaaacggtatcgccgggctaaccaatcagtggctggccaaaatcgcgaccacggtgatgcaggcgtttcccggtgcgttcccgaacgcggaagtggtgggtaacccggtgcgtaccgacgtactggcgttgccgttgccgcaggtgcgtctggccggtcgtgacggcccgattcgcgtgttggtggtcggcggttctcagggggcgcgagtcctgaaccagacgatgccgcaggttgccgccagactgggcgatacggttacaatctggcatcaaagcggaaaaggcgcgcagctcacggtagagcaggcatatgccggggcgggacaaccgcagcataaggtaacggaatttatcgatggcatggccgccgcctatgcgtgggcggatgtggtggtatgtcgttccggcgctttaacggtgagcgagatcgccgccgccgggttaccggcgatattcgtgccgtttcagcataaagacaggcagcagtactggaatgcgctgccgttagaaaacgccggcgcagctaagatttttgagcagccgcagtttactgtagaggctgtcgccgacaccctggcggggtggtcgcgcgaggcgttgttaaccatggcggagcgtgcccgcgcggtatccattccggatgctaccgagcgcgtcgccagtgaagtcagccgggttgcccggacataatttgtggcggtgccttttgcatcgcagggtttttctaccctcaataatttgggttgcaggcaagccaacgcatctgcaatttgaagtatggcgggtattggagttaatggcgtaaagaatgaatacacaacaactggcaaaactgcgttccatcgtgcccgaaatgcgtcgcgttcggcacattcactttgtcggcatcggtggtgctggtatgggcggtattgccgaagttctggccaatgaagggtatcagatcagtggttccgatttagcgccgaatccggtgacccagcagttgacgagcctgggggcgacgattttctttaaccatcgtccggaaaatgtgcgtgatgccagcgtggtcgtcgtttccagcgcaatttccgcggataacccggaaattgtcgcggcgcatgaagcgcgtattccggttattcgccgtgcggaaatgctggcggaactgatgcgttttcgccacggcatcgccattgccgggacgcacggaaaaaccacaacgaccgcgatggtgtccagtatttatgccgaagcggggctggacccgactttcgtgaatggcggattggtgaaagccgcaggcgttcatgcgcgtctgggccatagtcgttacctgattgccgaggcagatgagagcgacgcatccttcctgcatttgcagccgatggttgcgatcgtcaccaacatcgaagccgaccatatggatacctatcatggcgactttgaaaatttaaagcagacgtttattaacttcctgcataacctgccgttctacggtcgcgcggtaatgtgcgtcgacgatccggtcatccgcgagttgctgccgcgggtggggcgtcagaccacgacgtatggctttagcgaggatgctgacgtccgcgtagaagattatcagcagatagggccgcaggggcactttacgctgttgcgccagggaatgccggatctgcatgtcacgttgaatgcgccgggtcgccacaatgccctgaatgccgccgcggcagtggcggtagcgaccgaagaaggcatcgacgatgacgctatcctgcgcgcgctggaaagcttccaggggaccgggcgtcgttttgacttcctcggcgagttcccgcttgagccggtgaatggtaaagccgggacggcgatgctggtggatgactatggacatcatccgaccgaagtggacgccaccattaaagctgcgcgagcagggtggccggataaaaacctggtgatgctgtttcagccgcatcgttacacgcgcacgcgcgatctgtatgacgatttcgccaatgtgctgacccaggtcgatgcgctgctgatgctggacgtttacccggcgggcgaagcgccgattccgggcgcggatagccgttctttatgtcgcacgattcgtaatcggggaaaaattgacccgattctggtttccgatccggctcaggttgcgacaatgttagcgccggtgctgacgggtaacgacttgatattagtgcaaggcgcaggaaatgttggcaaaattgcgcgttacttatctgaaatcaagctgaagccgcaaatccaggaggaagagcaacatggctgataaaatcgcggtcctgttgggcggaacctctgcggagcgggacgtttcgttaaattccggcgcggcagtgttggccgggttacgtgaaggcggtattgatgcgcatcccgtcgatccgcaagaggtcgatgtcgcgcagcttaaagcaatgggctttcagaaggtctttattgcgttgcatggccgcggcggtgaagatggcaccttacagggaatgcttgaactgctcggcctgccttataccggcagcggcgtgatggcctcggcgctttccatggataaactgcgcagtaaattgctgtggcagggcgcaggcttaccggttgcgccgtgggtcgcgctgacgcgcgctgagtttgaaaaaggccttagcgaagaacaaaaagcgcgaatttcggcgctgggtttaccgctgatcgtcaaacccagccgtgaaggctccagcgtcggtatgacgaaagtagtagaagaaaatgctttacagggtgcgttatcattggcttttcagcatgatgacgaaatactgattgagaaatggctgtgcggtccggaatttacggtggcgatagttggcgaagaaattttaccgtcaattcgtatccaaccggcaggaaccttctatgattatgaggcgaagtatctctctgatgagactcagtatttctgccctgccggtttagaagcgtcccaggaagccgcgctacagtctctcgtcctgcaggcatggaaagctttaggctgcacgggatgggggcgtattgacgtcatgctggacagcgatggtcagttttatctgctggaagccaatacttctccggggatgaccagccatagtctggtgccgatggcggcgcgtcaggcgggaatgagcttctcgcagttagtggtacgaattctggagttggcggactgatatgtcgcaggctgcgctgaacacgcgaaacagtgatgaagagacgccttcttcacgccgcaataatggaacgcgtcttgcaggaatattattcctgctgacggtactgtgcaccgtgtttgttagcgggtgggtcgtgttagggtggatggaagatgcgcagcgtttaccgttatcaaagctggtattaaccggcgagcgtcactacacgcgtaacgatgatatccgtcaggcgatactggctctgggcgcgccgggaaccttcatgacgcaggatgtgaacattatccagagccagattgagcgtttgccgtggattaaacaggccagcgtcagaaaacagtggcctgatgaattgaagattcatctggttgaatatgtgccgattgcgcgttggaatgatcaacatatggtcgatgctgaagggaacaccttcagcgtgccgtcagaccgcatcggcaaacaggttttacccatgttgtacggcccggaaggcagcgcgagtgaagtgttgcagggataccgcgagatggggcaggtgctggctaaggataaattcactctaaaggaagcggcgatgaccgcacgtcgctcctggcaattgacgcttaataacggcattaagctcaatctcggcaggggcgatacgatgaaaaggttggctcgctttgtagaactctatccggttttacagcagcaggcgcaaaccgatggcaaacggattagctacgttgatttgcgttatgactcaggtgcggcagttggctgggcgccgctcccccctgaggaatctaatcagcaacagaatcaggcacaggcagaacaacaatgatcaaggcgacggacagaaaactggtagtaggactggagattggcaccgcgaaggttgccgctttagtaggggaagttctgcccgacggtatggtcaatatcattggcgtgggcagttgcccatcgcggggtatggataaaggcggggtgaatgaccttgagtcagtggtgaaatgcgttcagcgcgccattgaccaggcggaattgatggctgattgccagatctcctcggtatatctggcgctttccggcaaacatattagctgtcagaatgaaattggtatggtgcccatttccgaagaggaagtgacgcaggaagatgtggaaaacgtcgtgcatactgcgaagtcagtgcgcgtgcgcgatgaacatcgcgtgctgcatgtgattcctcaggagtacgccattgactaccaggaaggcattaaaaatccggtcggtctttccggcgtgcgtatgcaggcgaaagtacatttgattacctgccacaacgatatggcaaaaaacattgtcaaagctgttgaacgttgtggtctgaaagttgaccaactgatatttgccggactggcggccagttattccgtgttaacggaagatgaacgtgaactgggcgtctgtgtcgtggatatcggcggtggtacaatggatatcgccgtttatactggcggcgcgctgcgtcataccaaagtgatcccttacgcggggaacgtggtgaccagcgatatcgcttatgcctttggtacgccgccgagcgatgctgaagccattaaagttcgccacggttgcgcgctgggttccattgtcggtaaagacgaaagcgttgaagtaccgagcgtaggcgggcgtccgccgcgcagcctgcaacgtcagacgctggcggaagtgattgagccgcgttacaccgagctgctcaatctggtcaacgaagagatattgcaattacaggaacagcttcgccaacaaggggtaaaacatcacctggcggcgggcattgtgttaaccggcggcgcggcgcaaatcgaagggcttgctgcttgcgctcagcgcgtgtttcatacgcaggtgcgtatcggcgcgccgctgaatatcaccggtctgacggattatgcccaggagccgtattactcaacggcggtgggattgcttcactacgggaaagagtcccacttaaacggtgaagcagaagtggaaaaacgtgttacggcatcagttggctcgtggatcaagcgacttaatagctggctgcgaaaagagttttaatttttatgaggccgccagatattacggcctcaggcgacaggcacatgacggagagagattatgtttgaacctatggaactaaccaacgacgcggtgattacagtcatcggcgtcggtggtggcggcggtaacgctgttgaacacatggtgcgcgagcgcatcgaaggtgttgaattcttcgcggtgaataccgacgcgcaggcgttgcgtaagacggcggttggccagaccattcaaattggtagcggcattaccaaaggtctgggcgccggcgctaacccggaagtcggccgtaatgcggcggacgaagaccgtgaagcgctgcgtgcggcgcttgaaggcgcagacatggtatttatcgcggcaggcatgggcggcggtaccggaaccggcgcggcgccagtggttgctgaagtggcaaaagatttaggtattctgaccgttgccgtggtgactaagcctttcaattttgaaggcaaaaagcgcatggcatttgcggagcaaggtatcaccgagctgtccaagcatgtggactcgttgatcaccatcccgaacgacaagctgctgaaagtgctgggccgtggcatctccctgctcgacgcgttcggcgcggctaacgacgtgctgaaaggcgcggttcagggtatcgcagagctgatcacccgcccgggcctgatgaacgtcgactttgctgacgtgcgtaccgtgatgtctgaaatgggctacgcaatgatgggctccggcgtggcgagcggtgaagaccgtgcggaagaagcggctgaaatggctatttcttctccgctgctggaagatatcgacctgtccggcgcgcgcggcgtgttggtcaacattacggcgggcttcgacctgcgtctggatgagttcgaaaccgtcggtaacaccatccgtgcctttgcgtcggataacgccaccgtggttatcggtacctctctggacccggatatgaacgacgaactgcgcgtgaccgttgttgccactggaattggtatggacaagcgtcctgaaatcactctggtcaccaataaacaggtgcagcagccggtgttggatcgttatcagcagcacggtatggcgccgctgacgcaggagcaaaaaacggtcgcgaaagtggttaacgacaatgcgccacaggcggcgaaagagccggattatctggatatccccgcattcctgcgtaagcaagctgattaagaattagctggaatttgggattctgggctctttgtgctaaactggcccgccgaatgtatagtacacttcggttggataggtaatttggcgagattatacgatgatcaaacaaaggacacttaaacgtatcgttcaggcgactggcgtcggtttacacaccggcaaaaaagtcaccctgacattacgccctgcgccggccaataccggggtcatctatcgtcgcaccgacttgaatccaccggtagatttcccggccgatgccaaatctgtgcgtgataccatgctctgtacgtgtctggtgaatgagcatgatgtacggatttcaaccgttgagcacctgaacgctgctctggcgggcttaggtatcgataacatcgttattgaggttaatgccccggaaatcccgatcatggatggcagtgccgctccgtttgtctacctgctgcttgatgccggtattgatgcactgaactgcgccaaaaaattcgtacgcatcaaagagactgttcgggttgaagatggcgataaatgggctgaattcagaccgtacaatggttttacgttggatttcaccatcgactttaaccatccggcgatcgattccagcagccagcgctacgcgatgaacttctctgcggatgcgttcatgcgccagatcagccgtgcgcgtaccttcggttttatgcgtgatatcgaatatctgcagtcccgcggcctgtgcctgggcggcagcttcgattgtgccatcgttgttgacgattatcgcgtattgaacgaagacggcctgcgttttgaagatgaattcgttcgtcacaaaatgctcgacgcgatcggtgacttgttcatgtgtggtcacaatattattggtgcgtttaccgcgtataaatccggtcacgcattgaataacaaattgttacaggcagtcctggcaaaacaggaagcctgggaatttgtgaccttccaggacgacgcagaactgccgttggctttcaaagcgccttcgacggtactggcataacgacatacgctgtcgtataaaattcgactggttaacctggcactctctccggccaggcgagctagtcgttttttttttactatcctttatctgcgctttccttaatacagccattttgacagggttaaatggaaacacggcgcgttcgctgttttcttagccgattttcaccttagcttctcgtcattactgctgtagcgcgtacgctttaatgataagatttgtgcgcaaattgttttgattccgtaagcccatgaggggcatatcaggtggcaatgacgtgagtggaatactgacgcgctggcgacagttaggcagacgatacttctggccgcatctcttattagggatggtcgcggcgagttttggtttgcccgcgctcagtaacgccgctgaaaccaatacgcctgcaaggacgaccgccagcaccgcgtctaaagttaactttagccatcttgcgctgttagaagcctctaaccgtcgtcccaatttcaccgtagattactggcatcagcacgctattcgcacggtgattcgccacctttcttttgcaatggcgccgcaaacgctgcccgttgccgacgcgccgtcgccattacaggcgcatcatatcgccttactgaatacgctcagcgcgatgctcacgcaggagggcacgccgccggcgattgttcgccgcctctccctggcgtattttgcgccacaaaccgcatttagcatcccggcctggataagtcaggcgcagggtatccgcgccggtccgcaacgtctcagctaacgaaaaaagacccttttactttatttgtagctccgcggcgcggggcatttgagactttattatgctaatcaaattattaaccaaagtattcggtagccgtaacgatcgtacgctgcgtcgtatgcgtaaggccgtcagccttattaatgcgatggaaccggagatggaaaaactctccgatgacgaactgaaagcgaaaaccaacgaatttcgcgcccgtattggaaaaggcgaaagcgtagagagcctgattccggaagcgttcgcggtggtgcgtgaagccagtaaacgcgtctttgggatgcgtcacttcgacgttcagctattgggtggcatggtgctcaacgatcgttgtattgccgaaatgcgtactggtgaaggtaagacgctgaccgcaaccctgccagcctacctgaacgcgctgtccggcaaaggcgttcatgtggtgaccgtgaacgactatctggcgcagcgtgacgccgaaaacaaccgtccgctattcgaattcctcggtatgtccgttggtatcaacctgccaggtatgcctgcgccagccaaacgtgaagcttacgctgccgacatcacttacggcactaacaacgaatacggttttgactacctgcgcgacaacatggcgttcagcccggaagagcgcgtgcagcgtaaactgcattatgcgctggtggatgaggttgactccatcctgatcgatgaagcgcgtacgccgctgattatttccggcccggcggaagatagctcggaaatgtacaaaaaagtgaacaaaatcattccgcacctgattcgtcaggagaaagaagattctgacactttccagggcgaaggccacttctccgttgatgagaaagcgcgccaggttaacctgaccgaacgcggtctggtgctgatcgaagagctactggtgcaagaaggcattatggatgaaggcgagtcgctctactcgcctggcaatattatgttgatgcatcacgtcaccgccgcgctgcgcgcgcacgcgctgtttacccgtgacgtggattacattgtgaaagacggcgaagtcatcattgttgatgaacataccggtcgtaccatgcaggggcgtcgctggtctgacggtctgcaccaggcggtagaagcgaaagaaggcgttgaaattcagaatgaaaaccagacgctggcgtctattaccttccagaactacttccgtctgtatgaaaagctggccggtatgaccggtacggcggatactgaagccttcgaatttagttctatctataagctggacaccgtcgttgttccgaccaaccgtccgatgatccgtaaagatttgccggatctggtctacataaccgaagcggaaaaaatccaggccattatcgaagatattaaagaacgtaccgcgaacggtcagccagtgctggtcgggacgatttctatcgagaaatctgaagtggtctccagagagctgaccaaagcgggcatcaaacataacgtactgaacgcaaaattccacgccaacgaagcaggcatcgttgcgcaggctggttatccagcggcggtcactatcgctaccaacatggcgggtcgtggtaccgatattatgctgggcggtagctggcaggcggaagtcgctgcgctggaagcgccgacggaagaacagattgcgcagattaaagcggactggcaggtacgccatgacgcggttctggctgccggcggcctgcatatcattggcaccgagcgccatgaatcccgccgtatcgacaaccagctgcgtggccgttccggtcgccagggcgatccgggttcttcccgtttctacctgtcgatggaagatgcgctgatgcgtattttcgcctccgatcgtgtctccggtatgatgcgtaaactgggaatgaagccgggcgaagcgattgagcacccgtgggtgacgaaagctatcgctaacgcgcagcgtaaagtagaaagccgtaacttcgatattcgtaagcaactgctggaatatgatgatgtggcgaacgatcagcgccgtgcaatttatacccagcgtaacgaactgctggatgtgtctgacgtgagcgacaccattaacagcattcgcgaagatgtctttaaggcgactatcgacgcctacattccgccgcagtcgctggaagagatgtgggatatcccgggtttgcaggaacgcctgaaaaacgacttcgacctggagatgccgattgccgaatggctggataaagagccggagctgcatgaggagacgctgcgtgagcgcatcctggcgcagtccatcgaggtgtatcagcgtaaagaagaggtggttggcgctgaaatgatgcgtcatttcgaaaaaggcgtgatgctgcaaacgctcgattccctgtggaaagagcatttggcggcgatggattacctgcgtcagggtattcatctgcgcggctatgcgcaaaaagatccgaagcaggaatacaagcgcgaatccttcgctatgttcgccgcgatgctggaatcgctgaaatatgaagtgatcagtaccctgagcaaagtccaggtacgtatgccggaagaggtcgaagcgatggaaatgcagcgtcgcgaagaggcggagcgcttggcgcagatgcagcagctaagccatcaggatgacgatgccgccgtggctgccgatctggccgcccaaaccggcgaacgtaagattggacgtaacgatccttgcccttgtggttccggtaagaaatacaaacagtgtcacggtcgcctgagctgatgcgataaacttaccggcctgataagacataatgtgttgccatcaggtcggtcggtgctggcattattgccgaagggcgctacgcttattcggcctagcattgaacacagataaaaaggcgcaggcgactgcgccttttttatggatgcaccaagatgaaaaaactgcaaatcgcggttgggattatccgcaacccgaacgacgaaatttttattacccgacgcgccgctgatgcgcatatggcgaacaagctggaatttcccggcggaaaaattgaagccggcgaaacaccagagcaggcgttgatccgggagctacaggaagaggtggggattacgccaacacaggtgacattattcgacactctggaatatcaattcccggatagacacattacgctgtggttttggctggttgaacgctgggagggcgaaccgtgggggaaagaaggacagccgggacggtggatcgcgcaaaacgcgttgaatacggacgattttccgccggccaatgaaccgattattcgtaaattacgccaatttgcgccttagtgggggatcgcaacacgatccccatcgatcttattagcgatttaatgtcgacataatttccggccagtagcgggggccggctgcggcgtcgtgaggaaaaaccgcctcaattgccgccagctcctgcgggcttagggtcagtgataacgcgccgaggttttcatccaccctggcgcagtggcgggtgccgggaatgggaacgaggtgcctgttgcgggccagcagccaggccagcgctaattgtgcgggggtacactctttttcgcgtgccatttgttttattgcttcagccagacgtaaattgcgcgagaagttctcacccatgaatctgggatttgtgcgacggaagtcattcgcagcaaaatcttctggcgttttaatcgtaccggtcagaaatccgcgtcccagcgggctgtaagcgacgaatcctatacccaaccgttcacaggtggaaagtgctgaaatttccgcttcgcgggaccaaagcgaatactcactttgcagcgcggtaatagggtgaacgttatgggcgcgttccagcgtttgcgttgatgcttcggatagcccgagataacgcacttttccctcgcgcaccaggtccgccattgcaccgacagtctcttctatgggaactgatggatcaacgcgatgttgatagtacagatcgatatgatcgacccccaggcgttgcaggctttgctcacaactacggcgaacgtactccggtctgccattgacgccacgcgccatagggttagcagggtcgagaacgataccaaatttcgtcgctaaaaatacccgatcgcgacgatcggcgatggctcttccgactaacctttcattggtataagggccatacatatctgcggtatcgagcagtgttaccccctgatctaacgcataatgtagcgtcttaattgaggtgctgtcgtcatgagcgccgtaaaatgcgctcatgcccatacatcccagtccgatggctgacactcgcggtccgtttgcgcctaatgtacgatattgcatactgcctccatgaggatattttgtgcatggcaggcagtctatacctggcgtataagatgaaaaatagggggaataagcatggtttatgaaggctggcttaataatgcgtcatgatgtgatgtccgtattgcatgctttttgcatgattgctgaaaaccatagcttcacgcgggcagcggcgcagttacatatttccacgtcggcgttaagtcagaatatgcgtcaactggaggatgaacttggcgtgaaattattgaaccgaaccacccggcgtgtcggtttgacagaagcaggacatgcctttcttgccagtatcagacccgcattgaaccatattgatgaggcgatggaacatgcctgccagagccgcgatatacccggagggacattacgcctgaccgtaccgcgcacggcggccacgcttctgttacaacctaatctcgccggcttcatgcgcgattatcccgatattcggctggatatcgatgtgaatgacggttttgtggatttaattaacgaacgctttgatgccggtattcgctttggcgatgcggtacaacttgatatgaatgtcgttccgctcggtgatgttttacgcccggcgatcgtagcatcccctgcataccttgcgcgttttggcacgccgctgcatcctcaggagctcatcaatcaccgctgcctttgccatcgttttacgcgtgagagcgggctatatcggtgggagtttgttcatggagcgcaacggctggaaattacgccggaagccgcgttaatggtgaatgataaagcgttgcgtctctccgccgcgcgtgatggggcagagctaacctacgtttttgaacaggatgtccacgaagacttacaggatgggcggttgtgttccgtacttgaggagtggctgcctgcggcggaccggttttatttgtattatcccggccgcgcgcatatggcgccaaaactacgcgtatttattgattatttttgtcataaggcgatattgccgtctcaacagagctatcaccgttagcgctcttcgctccagtcgtcgctatcagactggtcgccgctgctggcgattcgtttctcttcggcggcccattcgcccaaatcaattaactgacagcgtttagaacaaaatgggcggaaggggctaatttccccccagacgaccggtttaccgcaggtcggacagtttacgacggtcacgtcagacatttttactccttagcaacaggccagttcaaaatcaagacgctccggcaccagaccattttcactatccagcggcataaagcgaatggcaaaacggctcttatggccggaaatttgcggataaagttgtgaatcgagcgtcagcataagacgcagcaaatcggcgtcgtccccgttatcctgataaaaaccgttcaggctggtttgcttacggaaaggcgctgaattacggatcagatcaagcaccagcgtcagcgcctgggtgaggggattcaggctggcaagccagctttcaatctgggcatcgcgctgcgcctgttgtaggtgcaaccagatatgcagagtgggtaaatcgaaactgcaacagccgccaggaatacttaagcgttgacgcacaagagcaatcaagcgatcttcgcgtagctgctggccaatcctcggggcggagatcagcacgctgcccgccgattttaactgctggcgcagggcttcaatacggtcttgatcgacgccgggaacctcaacccaggcctgtaatttacgctgctggcgctccagttctttcagcagttcggtacggacttcgccccgttcgaacacatccagtagatcgctgatattacggaaaaaatgcagtgcgccagcatggtctgcaattggcaggttgatggagagctgttggatcaaaaactctatgcgcagccacgtacgcatcttctcattgagagggtgttcaaataggacctgggtgtgcattacggtttttcctgtgagacaaactgcgacgcgagcttaagataactggcgtgcaggcgggccacatctgatgcgatagcatccggtgcgccgttattatcaataacatcgtccgccacggcaaggcgcgcttcacgcgtcgcctgcgcagcgagaatgtgttcaacatgctcgcgcgtaacatcatcacgctgcattgtgcgtatgagctgcgtttcgggcgtaacgtcaaccaccagtacgcggttggctttttgatacaacctgttttcaaccagcagaggcacaacccataacacatagggcgacgtagcctgttgaaactgtcgttgggtttcctgctgaattaagggatgaagcagagcgttaagccaggctttttcttccggatgcgaaaaaatacgctcacgcagtgcccggcgacgtaacgtgccgtcggcggcgataagttcagaaccaaaatgttccgctattgcgttcagggcgggctgccctggctcaaccatctggcgcgcgataatatccgcgtcgatgacggttattccgaggtcagcgaaggcatcagcgacggtacttttaccgctgccaataccgccggttaaggctacggtatacctcatatctccagcttccggaattttagtttgataatcaaaaggttaaattttaaacatacaaagacgatatgctctgagcattaacctactattcgccaggtaaatttatgggattgtaacgtaaaaaaagagaatttctgagtcttgtacggccatgattagtgcgtatgatagcgtcactggagttgtgagtttcgatttttcgccattaacctcaggaatccgcacatgcgtattgaagaagatctgaagttaggtttcaaagacgttcttatccgtcctaagcgttctaccctcaaaagccgttccgatgtcgaactggaacgtcaattcacctttaaacactcaggtcagacctggtctggcgtaccgattatcgcggccaatatggataccgtcgggacgtttgaaatggcgcaagcgttggccgggtttgatattctgaccgctgtacataaacattatagcgttgaagagtgggcagcttttatcaacacggcttcggctgatgttctcaagcatgtgatggtttccaccgggacctctgatgctgatttcgaaaaaaccgtgcagattctggcgctgaatcctgcgctgaactttgtctgtattgatgtggccaatggctattcagaacattttgtgcagttcgtcgcaaaagcgcgtgaagcatggccgtcaaaaacaatctgcgcaggcaatgtggtaacgggcgagatgtgcgaagagcttatcctctccggcgccgatatcgtgaaagtgggaattggtcccggctccgtatgcacgacgcgtgtaaaaaccggcgtcggttatccgcaactgtcggcggttatcgaatgtgctgacgcggcgcatggcctgggcggcatgatcgtcagcgatggcggctgcaccatgccaggcgacgtagcaaaagccttcggcggcggcgcggatttcgttatgttgggcggtatgctggcgggtcacgaagagagcggcggcagcgtggtagaagagaatggcgagaaattcatgctgttctacggcatgagttcggaatctgcgatgaaccgtcatgtcggcggcgttgcgaaataccgcgcggcagaaggtaaaacggttaaattgccactgcgtgggccggtgggcaataccgcccgcgatatcctgggcggtctacgctcagcctgcacttatgtcggcgcgtctcgcctgaaagagttgaccaaacgcaccacctttattcgggtgcaggaacaagaaaaccgcattttcaatagcctctaatattctggctggcgtaaatgtgcgccagccttatcccatcccgctcatcgcgtctcccaaatgaaaaatcggcaaatacatcgccaccaccagcgtaccgataattaagccggtgatgatcaataacgccggttccaacagcgacgccagattatcggccagcgccagcgtagattcactgtggtgacgggcaaggttatgcagcatgatatcgagtgaaccggacgcttcgcccgttctgaccagttgcaggcatagcggactaaattcctgggtattttttagcgccaaccagaccggattgcccgcggcgatctcctgatgtacctgcgttaaacgctgtgaccagtaagggcagccgagactatcgatagcgctttccagtccctgaagaaaaggaatgcctgcgctttgggttaatgccagtacggtgaatatttgcgctagtttctggcctcttatcaggcgacccataacgggaagccgtagcagaagacgctgccgctgcgcttgccaggacggtttttgttttaacctgcggtgagcgatagcaacgagcatcgtcaggaacaagatgagccaaccccatgccggcccccattgcgctatcgcgataataccgcgtgtcagaagaggaagcggggtattgaagctacggtaaatggcggcaaattccggcaggacaaagtgcagcatggcgaaaacgaccagggcggccattgttagaataatggcgggatagcgcagcgcctttttcacgctaaccgtaatctgccgttgcgctttttgctgacgggccagttcaaagcagcattcggccagtttgccggtcagttctccggtgcggatcatcgtctggtagagcggcggaaatacctgcggccaggagactaatgcgctggaaaaagggacgccctgttcaagctcgtgagccagcgtgcgcaacagcgcttgccattgtcggtggggatgctgtttcgcaaggagttccagcccttcagaaagcgtcagtccggcatgaatgagcgtggccaactgatgaataatttcagcgctttgctcttctttccacagtgcggcgttaacgcttatgcgcttgatgcgaagcggcataatgcgctgatgttgcagggtgatgatcagcgccagacgattgtccacccatacaacgtcttgttccagttgacctttatcgttaacgccttgccagcgccagagctgtttaacgctcatggggcattcccagaacgcgcagtatctcttcaaaggacgtcatgccttgctcaacggcgcgacagccattttcaaaaagcgtccctgtaccggtctgctggaggtgggcttccagtgcttgcgccgatgcgccgctcgcaattaactgacgtaatgccggggtaacggttaacacttcgaataacgcggttcggccataaaagccgtggtagcaatgctgacagccgtttgcctgccagcgcggtagcgcgctgggccaaagattgggcgatagcaccacgggatcgctcagacgctgtttgcagtgcgggcaaagcttccttaccaggcgttgcgctaccaccagcgtaagcgccgatgagatcatccagcgtgttacgcctatttgctgcaaacgtatcagggtttcgctggtggagttcgtatggagtgttgaaagtaccagatggcccgtttgtgccgccttaatggcgatttctgcggtgtcgccgtcacgaatttcacctaccatgatgatgtcagggtcctggcgtaaaagcgcgcgcagcacattttgaaaggtgagcccggcgcggggatggatctgcgtctggttaatcccatccagtggaatttctatcggatcctcaacgctacagaggttgatacccggcgtattccgggtttgtagcgcgctgtatagcgtgaccgtttttccgctaccggtggggccagtcaccagtaccagcccctgaggttgctgtagggcttgtctaaaagcggtaagttgtgccccgtacatgcccagcgtgtccagatccagcgtttgttcaacctgatgcaacaaccgtaagacgactttttcgccttctttacagggaagcgtggcgatacgaaaagagatgctgtcgcccgtcaggtcaacggtaaattgcccgtcctgcggcagccgatgttcagcgatgtccaaatttcctaggactttcaatctggccgtcagcgcaagccccgtctctttggcgatgtcctgcagaatatgaagaacgccatcgatgcggagccttatccggtagcggctggcgccgggttcgagatggatatcagaggcgcgtttcgccatcgccgagcgtaatgtctgattgagaagctgggccgcggtttctccgcctttcgcggcgtttgtcgagggtgcctgatccggcttatgccgatgattttccatttgctggcgagtccagcacacaatatcaatctgtttttgcgtggcgaaatgcagagcgtccaataacgcatgagagggcgcgtcgaccaccgcaacagtgatactgttgctggcgctattgatcagtacagcctgatgacgttgacacaaggtgttgagctgagcgtctttcatcttgtctccttagttggcgtcaaaacggaagacatcttcacaagcctgttgtaacgcgctgtcgctttgaatattgcagttacgcgtccagccggtaatgccgttagcattgtcccaggcgggcgtcatgatgacgctaagcccgctcagactctcctgaccggtaagcgtgatgacgcctttttccacgctcatgcccgaaacataacgggtgatgacgggcgaggggataccgttgacgcccgcatcgcatgtgctcgtcccaccatgttccagagcgcagagttcgacggcagtacggtaggggacaaatgtttgcaacatatccgtcagcgccgctttacgcagatagttctggtaagccggaatgccaatggcgcttaaaatggcgatgatgccaataacgaccatcagttcgataagcgtgaaaccgcgttgtttttccattgttcgctccttgagttagccggcgctactgtggcaaacaagggaagagcgggcgagcggcaaaaggtaaaacgggaaggcggattctgaagattttcgctgcgttacatgacacggcaacgttattgcgaggcgctacgaatattttaccgaatcacgacgcggatctacggacaggtgatttatagacccgacggcgcagcgccatcgggcggagaggatcagcaaaaacgcatggagagatcgagcgcgcgcacgtgcttggtcagcgcgccaacggagatgaaatccaccccggtttcagcaaattcgcgtaaggtttccgcggtgacgttgccggatacttccagccgcgcctggccgttgacgtgtttcaccgcctcgcgcatctggtcggtgttgaaattatccagcatgatgatatccgcgcctgctttcagcgcatcgtccagttcatccagattttcgacctcgacttctaccggcacgtccggatgtagccagaacgctttttccaccgcctgacgaaccgaaccggaggcgatgatatggttttctttaatcaggaacgcgtcagtgagacccagacgatgattggcgccgccgccgcataaaaccgcatatttgagcgcggtgcgcagacccggcagcgttttacgcgtgtcgagcaactgggtttgggtgccagccaatagtccaacgtagcggcgtacttcactggcgacgccggaaagggtctggacaaagtttagcgccgtgcgctcgccggtcagcaatacgcgagcggggccgttcagttcaaacactgtttggttggcgtgaatggcgtcgccgtcatcgacatgccaggtgaggcgcacatcatcgcccgccagttggatgaagacctcttcaacccagcgcttgccgcagaaaacgccgtcttcacgagtgatcactgtggcatgggcttgcgtatctgccggcaaaagttgcgcggtgatatcgttgccagcatcgacttctccacctaaatcttcacgcagcgcctgagcaacggcggcagggatatcgagattaatgcgttccagtagcgcgtcacgtcggtcgtctgggttataacggcgaggcggcatgataaaactccaaattgctaacgaatcataaggtagaaacatgctactctgaagcagctataagcaccactcaaaaggagactccgcatgttgccagataagggttggttggtagaggcgcgacgcgtcccttctccgcattatgattgccgtccggatgacgaaaaaccgtccttgctggtggtgcataatattagcctgccccccggcgagtttggcggtccgtggatcgatgcattattcaccggaacgatagatccagacgcccatcctttttttgcagaaatcgctcatcttcgtgtttcggcccattgtctgattcgtcgcgacggtgaaatcgtccagtatgtgccttttgataagcgtgcgtggcatgcgggcgtatcaaactatcaggggcgggaacgttgtaatgatttctccattggtattgagctggaggggacggatacgctggcttataccgatgcgcagtatcagcagctagccgccgtgacgcgcacgcttatcgcttgctatccggcgatcgccgacaatatgaccggacactgcaacattgcgcctgaccgcaaaacggaccctggccctgcctttgactggccgcgctttcgcgctttggtagccctctcgtcgcacaaggagatgacatgacgctgtttacgacattactggtgctgattgtcgagcgcctgtttaagctgggcgagcactggcagctcgatcatcggctggaggcgctattccgtcggattacgcatttttcgatgttgcgcacgatgggaatgacggcgatcgcgatggtggtgacttttctactgctccaggcgttaaaagggctgctatttaacgtgccgacgctggtggtgtggattctcctgggcgtgctgtgtatcggcgcgggcaaagtgcgagtacattatcacgcctggctgaaagcggcgtcccgtaacgatccgcatccttgcgaggcgatggccagcgagcttacgctgattcacggcgtgccgccggattgtaatgagcgtgagtttttgcgtgagctgcaaaacgcgttgttatggataaatttccgtttttacctcgcaccgctattttggtttatcgttggcggtccgtgggggccggtaacgctggtgggctatgcgtttttacgggcctggcagacctggctggcgcgctatcagacgccgcaccaacgtttgcaatccggcattgacgctattcttcatgtactggactggattccggtacgtctggcgggcgtagtgtatgcattactggggcatggcgagaaagcgttgccggcctggtttgcctcgctggcggatctgcatacttcgcaatatcaggtgctcacacgtctggcgcagttctcactggtgcgcgaaccgcatactgacaaagtagaaacccccaaagcggcggtatcgatggcgaagaaggcctcgtttgtggtggtggtgattattgcgttgctcaccatttatggggcattagtgtaatgttgtgccgatagcgctaacgcttatgctgcctacaatggaaaaatctgtaggcccggtaagcgctagcgccaccgggcagtgcaacggcttagatcgtatcggctggcggcacgccaaaatcaggcatcccgttttcgtcccagcgcacccgtttcagacgcgtatggcggttgggatcgtacaacggatcgccttcaatttcggtgtaatttctcgcgtggtacaccagtacatcttcaccttccgacgtttgcgtaaagctgttgtgtcccggcccatactggcgattttcatagctggtggtaaagaccgggcgcggtgatttatgccagttggccggatcgcgcggatcgtcgtttacgttaatccacagtaaccccatacagtagttttcatcggtggcgctggccgaatagctgataaacagcttgtcgccatgcaccacgacggccggaccttcgttaacccaaaaaccccgacattcccagtcgtactctggcttactgagtcttaccggctcgcctttaagggtccacggattttccagttcagccagataaatatttgagttaccggcaatatccggcgctttttgcgcccacagataccactgttttccctgatgataaaaagtggtggcatcgagggagaaggtatcaaacggcgttttaatttgacccttctccgtccacttgccggtgagtgggtcggcatcggcgcactccagggcaaacatgcggtgctggaacattcccagtttatcaagcgcttgagtatgggtagcggcaaaatagatgtaccacttaccgttgatgcggtgcatttccggtgcccagatgagctggctcatcgggccgctttccggtttgcgccagacgacaacggggtcggcggcgcgcaacccttccagcgaatcagcccggcggatttccagcctgtcatattccggtacggaggcaataaagtagtaatcgctgccgtcgcgtaaaataaacggatcggcacgttgttcaataaacgggtttggccagtttgccatcaggctttccttacgctttcagcggctttgagctcctgcaactcactcaattcgcggtaattagtgcgacgtttttccaaatcgtcctggatttttttcatcagttcacggtcaactttcagcagacgtaccacgcctgcggtaatcagatagccaacgccaaggataacggtaaacaacagcataataccgttcatcgccgaggcgctttgcgctttggcgctggcgtcataaccgtaccaggagagcaaaaagccgaccatcgccccggcaatcgccaggcccagtttcaggaagaacagattaccggagaagctaataccggtaatgcgtttgccggttttccattcgccgtaatcatcgacgtccgccatcagcgaccagtgtaacggggaagggatctgatgcagaatattgagcaagaagtagagcgccactatcatcacggtggctttcgggtcaaagaaatagaacgcgcaggagaaaatcgccagcgcgatattggtccagaaaaataccttcaatttacaccagcgatcggttaagacttttgccagcatactgccgatcatcataccgaccacgccaagactaataaaaagcgtagcgaaatgggtgctttgtcccatcacccaggtgacgtaatacatggtcgccgccatacggataaaccccgggcagacgttacataaggtcaatagcagaatgcgtacccattgatcgtttttccacacatctttgaaatcattcttcatatcatcgtgcgtcggaacggcagggcgaacgcgttcgcggacgctggcaaagcagaacagaaacatacccatgccgataatcgccagcacggtcatcgccaactgatagcctttggctttgtcgccgtcgccaaaccagtccaccatcggcaatagcgttaacgatagcaacagcgtcgcgatgccgactaacacgaagcgataagcctgacaggctacgcgctcttttggatcgttagtgatcacgccgcccagtgagcaatagggaatattgatggcggtataggtcacggaaagcagaaaataggtgacgaaggcatagataactttgctgttatagccccagtccggcgtcgtgaacatcagaacgctgaacagcgcgtagggaaatgcaatccacagtagccaggggcggaaacgaccatatttactttgggtacgatcggcaagcgcgcccatcaccggatcggtaacggcatcgataacgcgtactgaaaggagtaaaacaccgactaacgctggggcaagaccaaaaatatccgtataaaagtaattaacaaacagcatgatagcgccaaaaataatgttatatccggcgtcacccatgccatacccgattttctctcttaccgaaagtctgcccttatccattgagacttctccccatcagatgatggcggtaattattcgcctgcgagcttttttttgcgtagcaggatcacgccgctgatatggataaaatggttatacgtgggaaactgtgaggcagataacaccctccccggacggggagggcggaaaagtaacgccacgatcagtgggctttcaccgtttttgccgttttttctttacacaggtagccgacgcccaggatgagcagccataccggaatcagccacacggagatcgccatacctggcgtcatcagcataatgatcaataccgccgccataaacagcaggcagagaacgttgccgaacggataaaacagggccgggaagcgggttttcacgccctgctgctgtttcgcgcgacggaacatcatatgggcaaggctaatcatcgcccagttaatgaccagcgcggagaccaccagcgccatcagcagtccgaatgcggactctggggccaggtagttgagcagcacgcacaacgccgtcacgacggcggaaaccaaaatggagctcaccggcacgccgcgtttgtcgacgttcagcagcgctttcggcgcatttccctgctgggccagaccgaacagcatacggctgttgcagtaaacgcagctgttataaaccgatagcgcggcggtgagaaccacgatattcagcgcattggcgacaaacgtatcgcccagctcatggaagataaggacaaacgggctggtatcggcggtgacgcgagtccatggcagcagcgaaagcagaaccgccagcgagccgatataaaaaatcaggatgcgatagataacctgattggtagctttggggatgctctgttccgggttatcggcttcagcggcggtgatccctaccagctccagtccgccgaacgaaaacataataatggccatcatcatcaccagcccggtccagccatgcggcagaaagccgccctgttcccacaggttgcgcacggtggcctgcggaccagcggtatcgctgaagagtaaccacgcgccgaacagaatcatagcgatgacggcgatcactttaataatggcgaaccaaaactccatctcaccgaacactttaacgttggtcaggttgatggcgttgataatcacaaagaaggctgccgcagaagcccaggtggggatctccggataccagaactggatatatttacccactgcggtcagttccgccatggcaactaatacgtacagcacccagtagttccagccggaagcgaatccggcaaagccgccccagtatttataggcgaagtggctaaaagagccggcgaccggttcttcaaccaccatctctcccagctggcgcataatcagaaaggcaataaagcctgcaatcgcatagcccaggataattcctggccccgccgactgaataacggaggcgcttcccaggaacaagcctgtccctatcgcgccgcccaatgcgataagctgaatatggcggtttttcaggccgcgcttgagctgctcgccgtgctgctgactgtccatcataaaacctcgtgtatcgggcgcggtttattcataacgcgcttattttgaacgatgcagtagtgcgtgtgtaagtttgcaattccgctttttgtattgatttatttacaagctcgttttttaaaatgtcacttcaactctttcgtcttgatcagaataatggtatgtggccgcgaatgcacctgctttgtgcaggggtgatgacgagttgcgtaaaaagaaagcacttgtaaatacctccttttattttcccttctaaaggttaatttgtttttattcattatttatgcataaaaatgcatttgatctgctgttgaatcggttcagatgagattttttatcgtttcaaatacgttaaatctacctcctggtgggtaaatttaacatttgtgcacagttacagttttgaaacgtgatttctgtaaaattgttaaaatgtgcctcctttactgatttcaatcaaaacctgtatggacagaaggtgaatactttgttactttagcgtcacagacatgaaattggtaagaccaattgactccgggcaaatggcttaagacaggaaatcatggcctacagcaaaatccgccaaccaaaactctccgatgtgatcgagcagcagctggagtttttaatccttgagggaacattgcgtcccggagaaaaactcccaccggaacgtgaactggcaaaacagttcgacgtctcccgtccctccttgcgcgaggcgattcaacgtctcgaagcgaagggattgttgcttcgtcgccagggcggcggaaccttcgtgcagagcagcctgtggcagagctttagcgacccgctggtggaactgctctccgatcaccctgaatcccagtttgacctgctcgaaacgcgccatgcgctggaaggcattgcggcttattacgcggcgctgcgcagcaccgacgaagataaagaccgtattcgcgagctgcaccacgctattgagctggcgcaagagtccggcgatctggatgccgagtccgaagccgtgctccagtatcaaatcgccgtcaccgaagcggcgcacaacgtggtattgcttcatctgctaaggtgtatggagccgatgctggcgcaaaacgtgcggcagaacttcgaattgctgtatgcgcgtcgggagatgctgccgctggtgagcacgcatcgcacccgtatatttgaagccattatggccggaaaaccagaagaagcgcgtgaagcgtcacaccgacatctggcgtttatcgaagagattatgctggacagaagccgtgaggagagccgtcgtgaacgcgctttacgccgcctggaacagcgcaagaattagttttttctggcagaacgttaaccagaagatgttgtgaataacgcgcaaaaatgtgcgcggcaactaaacgcagaacctgtcttattaagctttctgacgaaagtttaatgggacaggttccagataactcaacgtattagatagataaggaatacccccatgtcagaacgtttccaaaatgacgtggatccgatcgaaactcgcgactggctacaggcgatcgaatcggttatccgtgaagaaggtgttgagcgcgctcagtatctgattgaccaactgctttctgaagctcgtaaaggcggcgtgaaagtcgcggcaggcgcaggggccagtaattacatcaacactattgccgttgaagacgaaccggaatacccgggtaatctggagctggaacgtcgcattcgttctgcgatccgctggaacgccatcatgaccgtgctgcgcgcgtctaaaaaagaccttgagttgggcggccacatggcgtccttccagtcttccgccacgatctatgatgtctgttttaaccatttcttccgtgcgcgcaacgaacaggatggcggcgacctggtgtacttccagggccacatctctccgggcatctacgctcgcgcgttcttggaaggtcgtctgacccaggaacagatggataacttccgtcaggaagttcacggcaatggcctctcttcctatccgcacccgaaactgatgccggaattctggcagttcccgaccgtctctatggggctgggcccaatcggtgctatctaccaggcgaaattcctgaaatatctggaacaccgtggcctgaaagatacctctaaacagaccgtttacgccttcctcggcgacggcgagatggatgagccggaatccaaaggcgcgatcaccatcgccacccgtgaaaaactggacaacctggtttttgttatcaactgtaacctgcagcgtcttgacggcccggtcaccggtaacggcaagattgttaacgaactggaaggcatctttgcaggtgctggctggaacgttatcaaagtcatgtggggcggtcgttgggatgaactgctgcgtaaagacaccagcggtaaactgatccagctgatgaacgaaaccgttgacggcgactaccagaccttcaaatccaaagacggcgcttacgtgcgtgagcacttcttcggtaaatatccggaaaccgccgcgctggtggccgactggactgacgagcagatttgggcgctgaaccgtggtggtcacgatccgaagaaagtctacgcggcactgaaaaaagcgcaggaaaccaaaggcaaagcgaccgtaatcctggcccataccattaaaggttacggcatgggtgacaccgcggaaggtaaaaacatcgctcaccaggttaagaaaatgaacatggacggcgtgcgttacgtccgcgatcgtttcaacgtgccggttgccgatgctgatctcgaaaaactgccgtacattaccttcccggaaggttctgaagaacacaaatacctgcatgaacgccgtcaggcgctgcacggctacctgccaagccgtcagccgaacttcaccgagaagttagagctgcctcaactttcagatttcggcgcgctgctggaagagcaaagtaaagagatttccactacgatcgctttcgtgcgtgccctgaacgtgatgctgaagaacaagtcgatcaaagatcgtctggttccgatcatcgccgacgaagcgcgtactttcggtatggaaggtctgttccgtcagattggtatctacagcccgaacggccagcagtacaccccgcaggaccgtgagcaggttgcttactacaaagaagacgagaaaggccagattctgcaggaaggtatcaacgagctgggcgcaggcgcatcctggctggctgcggcgacctcttacagcaccaacgatctgccgatgatcccgttctacatctactactctatgttcgggttccagcgtatcggcgacctgtgctggcaggctggcgaccagcaggctcgcggcttcctgattggcgggacttccggtcgtactacgctgaacggcgaaggtctgcagcacgaagatggtcacagccacattcagtcgctgactatcccgaactgtatctcttacgacccggcttacgcttatgaagtggctgtcatcatgcatgatggtctggagcgtatgtacggtgaaaaacaagagaacgtttactactacatcaccaccctgaacgaaaactaccacatgccggcaatgccagcaggtgccgaggaaggtatccgtaaaggtatctacaaactcgaaaccctcgaaggtagcaaaggtaaagttcagctgctgggctccggttctatcctgcgtcacgtccgtgaagcggcagagatcctggcgaaagattacggcgtaggttctgacgtatatagcgtgacctccttcaccgaactggcgcgtgatggtcaggattgtgagcgctggaacatgctgcacccgctggaaaccccgcgcgtaccgtacatcgctcaggtgatgaacgacgctccggctgtggcatctactgactatatgaaactgttcgccgagcaggttcgtacttacgtaccggctgacgactatcgcgtactgggtacggatggcttcggtcgttccgacagccgtgagaacctgcgtcaccatttcgaagttgatgcttcttatgtggttgtcgcagcgctgggcgaactggctaaacgtggcgaaatcgacaagaaagtggtagcggatgcgattaccaaattcaacatcgatgcagataaagttaacccgcgtctggcgtaagaggtaaaagaataatggctatcgaaatcaaagtaccggacatcgggacagatgaagttgaaatcaccgagattctggtcaaagtgggcgacaaagttgaagctgaacagtcgctgatcaccgtagaaggcgacaaagcctctatggaagtcccgtctccgcaggctggcgtcgtgaaagagatcaaagtctctgtcggcgacaaaactgagaccggtgcacttatcatgattttcgattccgccgacggtgcagctgacgctgcgcctgctcaggcagaagagaagaaagaagcggcgccggcagcagcacctgctgcggcagcggcgaaagacgttcacgttccggatatcggcagtgacgaagttgaagtgactgaagtgatggtgaaagtgggcgacaccgtagaagctgaacagtcgctgatcaccgtcgaaggcgacaaggcctctatggaagttcctgctccgtttgcaggcaccgtgaaagagatcaaagtgaacaccggtgataaagtgtctaccggctctctgattatggtcttcgaagtggcgggtgaagcgggcgcagcagcaccagcgaaagcggaagccgctccggctgcggctgctccagcagcagcgacgggcgtgaaagacgttaacgtaccggacatcggcggcgacgaagttgaagtcaccgaagtgatggtcaaagtcggcgataaagttaccgctgaacagtcgctgatcaccgtggaaggcgacaaagcctctatggaagtgcctgcgccgttcgcgggcaccgtgaaagaaatcaaaatcagcaccggcgataaagtgaaaaccggctcgctgattatggtcttcgaagtggaaggcgcagcgcctgcggccgctccggctaaacaggaagcagcggcgccggctccggcggcgaaagctgagaagcctgctgccccggctgccaaagccgaaggcaaatctgagttcgctgaaaacgacgcttacgttcacgctaccccactgattcgccgtctggcgcgcgagtttggcgtcaacctggcgaaagtgaaaggcactggtcgtaaaggccgtattctgcgcgaagacgttcaggcttacgtgaaagacgctatcaaacgcgcggaagctgcgccggctgctgcgggcggcggtatcccgggtatgctgccgtggccgaaagtggacttcagcaagtttggtgaagttgaagaagtggaactgggccgtatccagaaaatctctggcgcgaacctgagccgtaactgggtgatgatcccgcacgttacgcacttcgacaaaaccgatatcaccgatctggaagcgttccgtaaacagcagaacgccgaagctgagaagcgcaaactggatgtgaaatacacgccagtggtcttcatcatgaaagcggttgccgctgctctggaacagatgccgcgcttcaacagctctctatccgaagacggtcagcgtctgaccctgaaaaaatacatcaacatcggcgtggcggttgataccccgaatggcctggtggttccggtctttaaagacgtgaataagaagagcgtgaccgagctgtctcgtgaactgaccaccatctccaaaaaagcgcgtgatggtaagctgaccgctggcgaaatgcagggtggttgcttcactatctccagcatcggcggcctgggaactacccactttgcgccgattgtcaacgcgccggaagtggctatcctcggcgtttctaagtcggcgatggaaccggtgtggaatgggaaagagtttgtgccgcgtctgatgatgcctatctctctttctttcgaccaccgtgtgatcgatggtgctgatggtgcgcgtttcattaccattatcaacaatatgttgtctgacattcgccgtctggtgatgtaagcgaaaaagccggcccgacggccggcttttttttgataatctcatggagtttgtgaggttattagcgaaagcgataattcgtgatccgtttgttgtttcaaaattgttaacaattttgtaagatacgggcggatagaacgacccggtggatgatgggcgatcaagtaccccggaccgccggatacaaataaagaggtcatgatgagtactgaaatcaaaactcaggtcgtggtacttggggcgggcccggcaggctattctgccgctttccgttgcgctgatttaggtctggaaaccgtaattgtagaacgctacaacacccttggcggtgtttgtctgaacgtcggctgtatcccttctaaagcgctgctgcacgtagcaaaagttatcgaagaagccaaagcgctggctgaacacggtatcgtcttcggcgagccgaaaaccgatatcgacaagattcgtacctggaaagagaaagtgatcacgcagctgaccggcggtctggctggtatggccaaaggccgtaaagtgaaagtggtcaatggtctgggtaaattcaccggggctaataccctggaagtggaaggcgaaaatggcaaaaccgtgatcaacttcgataacgcgatcatcgcggcgggttctcgtccgatccaattaccgtttattccgcatgaagacccgcgcgtatgggattctaccgacgctctggaactgaaagaagtgccgaagcgtatgctggtcatgggcggcggtatcatcggtctggaaatgggtaccgtataccacgcgctgggttcagagattgacgtggttgaaatgttcgaccaggttatcccggcggctgataaagacatcgttaaagtcttcaccaaacgcatcagcaagaaattcaacctgatgctggaaaccaaagtgactgccgttgaagcgaaagaagacggtatctacgtttcgatggaaggcaaaaaagccccggctgaagcgcagcgttatgatgcggttctggtggcgattggtcgtgtgccgaacggtaaaaacctcgacgcgggcaaagctggcgtggaagttgacgaccgtggctttatccgcgtcgacaaacagctgcgcaccaacgtgccgcacatcttcgctatcggcgatatcgtcggtcagccgatgctggcgcacaaaggcgttcacgaaggccacgttgccgctgaagttatcgccgggaagaaacactacttcgatccgaaagttatcccgtctatcgcgtacaccgagccagaagtggcatgggttggcctgaccgagaaagaagcgaaagaaaaaggcatcagctatgaaaccgccaccttcccgtgggcagcttctggccgtgctatcgcttctgactgcgcagacggtatgaccaaactgattttcgacaaagaatctcaccgcgtgatcggcggggcgattgtcggtaccaacggcggcgagctgctgggtgaaatcggtctggcgatcgaaatgggctgtgacgcggaagatatcgcgctgaccatccatgctcacccgactctgcatgagtccgtgggcctggcggcggaaatcttcgaaggtagcattaccgacctgccaaacccgaaagcgaagaagaaataatcttctgcgggtggcaatgcgccacccgatacagaaaagcggctttacagccgctttttttatgcatggcaaatcagatgtgtcaaatgatggcgaaggataacgaaaccgcaaaatttatcctttccgcagcagtacgtttttcaaagcttatgccgtcggtagtgcctttgtctgtcattttcgaccaactaattgtttcataagaaatacctctccttaatttgtcatcatcctgaaattggtaacgctataaaataatagcgagctaattatgaggtttgatatatgaaactttttctgacaacggcagcgctaactgcgaccttgatttccggcatggcatttgccagcgatcccgtcatcccctgggcgactaacagcggcggtacggaaagcacgcatattgcggcaatgggcgaggatttgaatgcgcagcatcagcagatcacccacacgcatgaaggcgtatgggcggccaattccggcagcattcaggctgatgaagccgcgctgaccagcaacaagccgccggtacaaggccacccggaattgatgccgcatcagggctaatgatcacggcctggcgataacgccaggcgcttacgggttattcggcgacctgccactgcgcgtctggcgcaaaacgcgtgatagcctgaactttactctccgtctccttgcctaaatccgcctgataaatacgatcgtcctggttgaccataaaactcatcaccccggtttcgccgtaatgcatcggccaggccagaagcgccgcaccgtgaccgtcgttatcgctgataatacggaaatggtagccgtggtaaccctcgtctggcgctgcgggactaaagtttgggcctaacggactggggacgtcgcctgctttggttggccagtacaggccatctttttggccttcgctactgattatcctgtgcgcccagcgatggttttgtaagtaatagtcctgctgcgcatcaacgtaagcatgcatggcctgtaaggtagaaagttcatttcgcccaatagtacgggtgaggatctcattcccggctgccgccatatcaaagcgccagccgccagtctctttcaccatgggcaccgggagctgccagtcttctcgtccgacattcaggtgcgccgtattgtctttttgtacaatgcgatggccttcgcgccagtcacgattgaagcgggccacggcctcgggatcggcaccttccggcggcagaaattgccgccagtcatcgcccagtagcgcggtaagctgcgtttcgttttttccggctaccgccgcggcgaaggcgctggcggccgcttccggggaggggaaccgttcctgcgcgtagcccagcaagggtaacgacagtaacagagcgcttaacataacctttttcattatctgctccggttaacggcgatgaaattcatgatgttcagaaaaatgttcccgcgcggcggcgcgttgctcggtgttcaagtgactgccgcgacggctttctaggccgcgtagctgttgcgattgccatgacggcgatcgactgtcgttcccgctaaacacattggcgtgcatattctggcgaaatgcctgacgctgctgtggcgtagaggattcaatacgctggcgggcggtgtctctctgctgttgtgaaacagggtgctgctgggctttagccttcagctcggaacgatgctgctgcgtggtggatttattcagtgtctgctgcgccgcctcgcgacgactgctgttttgtgttccgtcatagccacggtaattattacgctgggcaatttgatttaactgctgcgatgccgctttgcgctgtctgtcgcgggatgtctcgcctgacacgttagcgggtgatgtatggctgcgctgttggaattgcgccatggctgcctggcgctgactgtcgcgagacactggcgcttgctgcgttgcgcttaacccgccgctaacattggtgggatggaaccgttgcgcaacggtattattcggataggggacgccattgcgccaggcgggattatgctgccagcccatcgtttggcccggcaggttttgcccggatatccggttgaaattattgacattgatgttgatattatcgccattatgttgataaccgttaccaccatgatggtaatcatcatcatgatggtcgtcgtcatggtggtgatgatcgtcgtcatcccagtctatgctgctgaacaacgcataggtggtggcgacgcccagactataaccaaaacctttaacaaaactgtcggcaaactgctgccccggagggggcggtaaatacaccggcggataagcggtattgggccaggcgccatacaccgtcgtggggttatagtttggcacgtacaccacctgcggattcgcaggttcaattttgatgacggtcgacggtgttgctggcgtactggcggatgtggtggttgtcgtcgtgacggcggtagaagcgctggacttcggcacgctggtgacggtttgctgtggcgtggattttagcgaaccggtttgttgagcgagcagacgcagcctttgcaccgcatccatcacatcctgtggctgggctaagaacgcatcgcccaggttttgcacccattgcggattctcgcccataagcgccatcaactgaggaaaggcgaccagcgatttgacgctggggtcccacggttggctggccaccgcttgaatagcggcatcgccctgcagcgtggggttatcccgcgaccactggacggcctgaaccacgttcgccgggtaggtggaggccatgagcacctgcgaaagcagggcatcgggataaagcgcgacaggcgcgacccattgatcgatttgcgcagtggtaaaggtcgttttcgcgacaggcgcgggcacagcggtctgcgttggctcagaggtgggagctgccgcctgcgcgggcgcttcgggagcgcggcttttaacatacagtacgcccgaagcggcaaataacccggcactgcacacaagggcaatgagatggggtttaaagggcaacgtcattttatctctcccgattcccgagaatcgctatggtcattatgcctgccgccgacggggtgcagtttggcgtgagtataaagggacgatagtttaatttttagctaatgttgggatcggtaacgttacgtgacgatcaaagcacgaaatgaggtaagcatttatggctgcagctcccgtctcagtagagcattagaccatccttaacgattcagccacttttttatgttgcttttttgtaaacagattaacacttaaagaaaatcctgttattgtgccttatgcggtaccgggcatttaccctactaactactgtctcacaggagcgtgaagagaatcgcccatcaacaaaagcgccgcattatgacaatgagagcgaggagatatcgtcgtgctagaagaataccgtaagcacgtagctgagcgtgctgcccaggggattgtgccgaaacctttagacgcaacccaaatggctgcgcttgtcgagctgctgaagaccccgcctgtgggcgaagaagaattcctgttagacctgttgatcaaccgcgttcctcctggcgtcgatgaagccgcttatgttaaagccggttttctcgctgctgtcgcgaaaggcgacaccacctccccgctggtctccccagaaaaagccattgaactgctgggcaccatgcagggtggttacaacattcatccgctgattgacgcgctggacgatgcgaaactggcgccgattgcggccaaagcgctgtctcacaccctgctgatgttcgataacttctacgacgtagaagagaaagccaaagcgggcaatgaatatgccaaacaggtgatgcaatcttgggccgacgccgaatggttcctgagccgtccgccgctggcggaaaaaatcaccgtcaccgttttcaaagtgaccggcgaaacgaataccgacgatctctctccggcgccggatgcgtggtcgagaccggatatcccgttacatgcgcaggcgatgctgaaaaacgcccgtgaaggcattgagccggatcagccaggcgttgtcggcccgatcaaacaaatcgaagcattgcagaaaaaaggctacccgctggcctacgtgggtgacgtggtgggcaccggttcttcccgtaaatccgcgaccaactccgtgctgtggttcatgggcgatgacatcccgaacgtgccgaacaagcgcggcggcggtctgtgcctcggcggcaaaattgcgcctatcttctttaacaccatggaagatgcgggcgcgctgccgattgaagttgacgtttctaacctgaacatgggcgatgtaattgacgtctacccgtacaaaggcgaagtgcgcaatcatgaaaccgatgaactgctggcaaccttcgaactgaaaaccgacgtgctgatcgacgaagtacgcgccggtggccgtattccgctgattatcggacgtggcctgaccaccaaagcgcgtgaagcgctgggtctgccgcactctgacgttttccgtcaggcaaaagacgtggcagaaagcagccgtggcttctctctggcgcagaaaatggtcggtcgcgcctgcggcgtgaaaggcattcgtccgggcgcgtactgcgaaccgaaaatgacctccgtcggttctcaggatactactggcccgatgacccgtgatgagctgaaagacctggcctgtctgggattctccgccgatctggtcatgcagtcgttctgtcacaccgcagcctatccgaagcccgttgacgtcaccacgcaccacacgctgccggacttcattatgaaccgcggcggtgtctccctgcgtccgggcgacggcgtgatccactcctggctgaaccgtatgctgctgccggacaccgtcggtaccggcggtgactcccatacccgtttcccgattggtatctctttcccggcgggttctggtctggtggcgtttgccgccgcgaccggcgtgatgccgctggatatgccggaatcggtgctggtgcgcttcaaaggcaaaatgcagccgggcatcaccctgcgcgatctggtccatgccatcccgctgtacgccatcaaacagggcctgctgaccgttgagaagaaaggcaagaaaaacatcttctctggccgcatcctggaaatcgaaggtctgccggatctgaaagtcgagcaggcgtttgagctgaccgatgcttctgccgagcgttccgctgccggttgtaccatcaagctgaacaaagagccgatcgttgaatacctgacctccaacatcgtcctgctgaagtggatgatcgccgaaggctacggcgaccgtcgtacgctggaacgtcgtatccagggtatggaaaaatggctggcggacccgcagctgctggaagccgatgctgacgcggaatacgcagcggtgatcgacatcgatctggcggatatcaaagagccaatcctctgtgcgccgaacgatccggacgacgcgcgtctgctgtctgacgtgcagggcgagaagatcgacgaagtgttcatcggttcctgcatgaccaacatcggccacttccgcgcggctggtaagctgctggatagccacaaaggccagttgccaacccgcctgtgggtagcgccgccaacccgtatggacgctgcgcagctgaccgaagaaggttactacagcgtgtttggtaagagcggtgcgcgtatcgaaatcccgggttgttccctgtgtatgggtaaccaggcgcgtgtggctgacggcgcgacggtggtttccacttctacccgtaacttcccgaaccgtttaggtactggtgcgaacgtcttcctggcttctgcggagctggcggcggttgcagcgcttattggcaaactgccgacgccggaagagtaccagacctttgtggcgcaggtggataagacggcggtggatacctaccgttatctgaacttcgaccagctctctcagtacactgagaaagcggatggggtgattttccagactgcggtataatttgcctgacggcgtcaggcttaccatgcctacgcctcttattgcccggtggcggctacgcttaccgggcctacaaaacccatcgcaactgcggtgggtttttattttcattccgcctgctgttcccgctttttttcttctccgctgctgcgataatgactgtaagggctttgcagaggaacacattatggattacgaatttctgcgcgatgtgaccggacgggttttggtacgaatgtcgatgggccacgaggtggtcggtcactggtttaatgaagaggttaaagacaacctctcgctactggatgaagtagaacaagccgcgcgtacggtcaaaggcagcgaacgttcctggcaacgagcagggcatgagtacacgatctggatggacggcgaagaagtgatgattcgcgccaatcagctggatttttccggcgatgagatggaagaggggatgagttattacgatgaagagagtttatccctgtgcggcatggaggattttctgcgggtcgtcgccgcgtatcgggaattcgtcagtaaagcctgaccctctcttcgttattgccccgcaacgcctgtcgacggacagttgggggcggtagtggaaacgaaatcaccacacattccagccgggagtatcccggcttttttattgcagaatgattttttgatttttattaatcattttaaaactgtgatctgacgcgtttgtgatcttaatttgattgaatataatcgttatgattttattcaatcacaacaagcaacaggcggtaagaccatgaacatcaaaaaagcaatagagcgcgtacccggcggcatgatggtcgtaccgctcgttattggcgcagtcattaacaccttcgccccgcaggcgcttgagattggcggttttaccactgccttatttaaaaacggcgcggcgccgctgattggcgcttttctgctgtgtatgggagccggtatcagtgtgaaagccgcgccccaggcgttattgcagggcgggacgattacgctcactaagttgcttgtcgccatcggcattggcctgggcgtggagcatcttttcggcgcggagggtatttttggcctgagcggcgtggcgattatcgcggcgatgagcaattcgaatggcggactttatgctgcgttggtaggcgaattcggcaatgagcgcgacgtcggcgctatctctattttgtctcttaatgatggccctttctttacgatgattgcgctgggcgcggcagggatggcgaacattcccattatggcgctggtggcggtgctggttccgctggttgtcggcatgatcctcggcaatcttgatcctcatatgcgcgattttttgaccaaaggcggcccgctgctcattcctttctttgcttttgcgctgggggcgggcatcaacctggaaatgttactgcaaggcggacttgccggaattctgctcggcgtgctgacaacgttcgttggcggtttctttaatattcgcgcagatcgtctggttggcggaactggcattgccggggcggcggcctccagcactgcgggtaatgccgttgcgacgccgctggctattgcgcaggccgacccttcgctcgccgaggtggccgctgctgccgctccgctgattgccgcctcggtgatcaccacggcaatcctgacgccagtgttgacctcctgggttgcgaaaaaacaggcgcgtcaggcttctttggagaaaaacgcatgaaaatgatggttatcgccgatgattttaccggatcgaatgataccggcgtccagttggcgaagaagggggcgagaacggaagtcatgttgagcgcgtcgcaaaaaccgtcccgccgcgccgatgtgttagtcattaacaccgaaagccgggcgatgcccgcagatcaggcggcatctgccgtttatgccgcgctttccccgtggtgtgagacatcgccagcgccgctggtgtacaaaaaaatcgactccacatttcgcggcaatatcggcgccgaagtgacggcagctatgcgcgccagtcagcgaaaactggccgttatcgctgctgcgatccctgcggccggacgcacgacgcttgaaggaaaatgtctggttaatggcgccccgctactggaaaccgaatttgctagcgatccgaaaacgcccattgtctcttcccgtattgccgagatagtggcgttgcaaagtgagatccctgtgtatgaagtctttttacaggatgtccgacgcggcgggttaagcgccttacttacggcttatgcggctgagggcgaagggattatcgtcgtggatgcggtagaagagcgggacctgacgttgattgcgcaagcggcgtgcgaacaaccgtcgatgccgctgctcgtcggcgcagctggtctggcgaatgcgttgccggttgaactttttatgcaagaccggcagcggctaccggtactggtggtagccggttcgatgagcgaagccacgcgacgtcaggtggataatgcgctgtgccggggacgtgcggaggtcgtggatatcgatgccgcgcgcatggtgtcggatagcgcggagcaggaaatcgcgtctgtcgtagagcaggcctgcgcgctgttaagtcagcatcgacatacgattttacgcaccagccgtcgcgcagaagatcgacagttaatcgacgcgctgtgcgaaaaatccgcgatgagccgtcagcaattgggcgagcgactgagtcatcggcttggcgtcgtcacgttaaatattatcgagcaggcgcggattggcgggctgtttctgaccggcggcgatatcgctaccgccgtcgccggcgcgcttggcgctgaaggttatcgcattcagagcgaggtggcgccctgtattccctgtggaacgtttgtaaacagcgaaattgacgatctgccggtcattaccaaagcgggcggattcggttcagacagtacgttgtgtgacgcgctttattatattgaggagatgtattgtggagactaaaaccgttgccattaccatgggcgatccagcgggcattgggccggaaattattgttaaagcgctaagtgaagacggtctcaacggcgcgccgctggtggtgattggatgcctcgcaaccttgaaatgtttacaggcgaagggcatcacgccgaacgtcgagttacgggccattgaacgggtcgccgaagcgcgttttgcgcccggcatcattcatgtgattgatgagccgctggcgcagccggaggcgctggaggccgggaaagttcaggcgcaggcgggggatttagcgtatcgctgcgtgaagcgcgccaccgagttagcgttacggggcgacgtacaggctatcgctaccgcgccgctgaataaagaggcgctgcacctggcggggcacaactatccgggccataccgagctgctcgcgactctgacccatagccgcgattacgcgatggtactttacaccgataaactaaaagtgattcacgtttcaacgcatatcgcgctgcgtaaattccttgatacgttaagtaccacgcgtgtcgaaacggtgattggtattgctgatactttcctcaagcgtgtgggttacgttaaaccgcgtatcgccgtggcaggcgtgaatcctcatgcgggcgagaatggtctgtttggcgatgaagagacgcgtatcctgacgccagccattaccgatgcccgcgcaaaaggtatggacgtttatgggccgtgcccgccggatactgtatttctccaggcttatgagggacagtatgatatggtggtggcgatgtatcatgaccaggggcatatcccgttgaaattgcttggcttttatgatggcgtgaatatcaccgcagggctgccgtttatccggacctctgccgatcatggcaccgcatttgatatcgcctggacgggaaaagcaaaatctgagagcatggccgtatcgatcaaactggcaatgcaactggcataattccctgttatgaaaggacaacaccgtctggatctcattgtggcgtatctgaaaaaccatacgctggttacggtagaacagctggttgaggcggttgacgcatcgccagccactatccgtcgcgatttgatcaagctggatgagcagggcgtgatcagccgtagtcatggcggcgtggcgctgcggcgttttgaacccgcccagcccaccaccaatgaaaaacaactgcgatcgcccgctgaaaaacgggcgattgcacgcgttgccgcatcgctggtcaatgctggcgatgccgtcgtgctggatgccggtacgacaatgatggaactggcgaaatgcttaacccatcttccgctgcgggtcatcaccgtcgatctgcatattgcgctgtttttagctgagttccggcaaattgaagtgacgattgtcggcggtcgtatcgatgacagcagtcagtcctgtatcggtgagcatgggcgcaagctgttgcgcagcgtttatccgaacatcgcgtttatgagctgtaattcatggggggtaaaaacgggcgtgacgaccccaacggaagataaggccgggcttaaacaggagattattgctaatgcgcagcgcaaagtgttgctggcggacagcagtaagtatggcgcgcattcgctctttaatgtggtgccgcttgagcgctttaatgatgtgattaccgacgtcaatctgccgccgtcagcgcaggttgaactaaaagggcgcgcttttgcgctaacgctggtgcagccggagtgacagcgccgtcaggcgctgccagtggtgaatcagaccgcagaaatattgcggccgtagtaaatctcgcgcatctctttccacagcgcggcggtgatctgctggcgttcggtttcagtgagatcttccggtttggtgtgaaacatatagtgcttaagatcgaactctttaagcagcatcttggtatggaaaatattttcctgatacacgtttacatccaccatgtcatacagcgacttcatatcttccgacataaaattctgaatggaattaatctcatgatcgataaagtgtttcataccgttgacgtcgcgcgtaaagccgcgcacgcggtaatcgatggtgacgatatcagactctagctggtggatcaggtaattgagcgcttttagcggtgaaatcaccccgcaggttgacacttcgatgtcggcgcgaaaggtgcaaagcccgccttccggatggctttccggataggtatgcacacagatatggctcttatcgaggtgcgccaccacggtttccggcagcgggccgggatgttcggtttggtcgataagtttcgggtcgatcggctcttcgctcaccagaatcgtgacgctggcgccctggggttcataatcctgacgggcgatgttcaggatgttcgcgccgataatggagcaggtctccgacaggatctcggtcagtcggttggcgttatagagttcatcgatataggcgatatagccatcgcgctcttctgcggttttggcgtagcagatatcgtaaatacaaaaactcaggcttttcgtcagattgttaaagccatgcagtttcagctttttcaatttttatcacctccttaacgtcactgtgcggacagtgcgtcatgtagatattgcggtagcgcaaatgcagcggcatgaatagccgagttgtaatagcggcatttgaggccggcggcatgaaaacgcgcctgaataatttcgctcgacaggtggcgaagagcgtcgttgtccgtcgcccaggcgaaggtcataatgccgccgtaataggtcggaatcgccgcctggtagaagccgacatcgctgaagtaatgactcagcttgcggtggctgtcgagcgcttcatcctgttgcaggaagcacacgccgttctgggcgacaaaaatgccgcccggattcaggcaacgcttacagccttcataaaaggcggaggtaaacaggctttcgccggggcctatcggatcggtacagtcggaaatgatcacatcaaaggtctgatgggtctgattgacgaaattcacgccgtcgtcgatcaccagcgtaaagcgcggatcgtcgtagctgccggcattgtggttgggtaaatactggcggcaaaacgagactacgccagcgtctatctctaccatggtgatggtttcgacgtttttatgccgggtaacttcacgtagcattgcgccgtcgccgccgccgataatcagaacgtgtttcgcatgaccgtgcgccagcagcgggacatgggtcatcatttcatgataaataaactcgtcgcgttcggtggtctgtaccacgccgtccagcgccatcacgcggccaaaagcggcgttttcaaagatgattaaatcctggtgatcggttttttcatgatacagaacgttgtctacggcaaagtactgaccaaactggtcgtgtagcgtttcatgccacatcgtattttcggccattggctgatacctccattgttaacacccgtaaaaaaagggcgcaacatcatagctaacaatgaccgtggatgcacggtcattatttcagcaataggatcgcggaggattatttaacgtaggctaacaggctcagagaatcgcgggccagagctttgcattttttagcgaccggaataccgatgccgctaagatcgcggtagctgtcttcgcccaacgatttcatatcgaaggtgtcgtagttactcaggtcccactgattttgctgggcaaaaaagaccagcgcacggcgaatctgactgttgggtaaattttggtaaccacagtcatttttcagaaaaacgaaaaccgccgttaaatcggccatatcttcagcttcggattcagtaagcgcatagctatttgcgcataaggccatcaggctgccaaacaacacgggtctgaaaaacgtcttcattgcttctaccacggcatcagggaaagtcaacgttagcatactgagaacgtagcgacgacttttattatcaggattggtcgcggcgttttcattcttgttgtattgctgtcaggaacggtaaagacgtgttgctggcttgaccttcccgttagggcagggtctaagcttagacacccgcctgttcattataaggaaatgattatgttacgccgtgatttcttaaaatattcagtggcgctgggggttgcatcagcgctgccgctgtggagccgcgccgcttttgccgccgaacgtcccgcgttgcctattcctgacctgttaacggcagatgcgagcaaccgtatgcagttaattgttaaagccggacagtcgacattcgccggtaagaacgcgacaacctggggctacaacggtaatttgctggggccagcggtacagcttcacaaaggaaaaagcgtgaccgttgatatccataaccaactggccgaagacacgacgcttcactggcatggtctggagattccgggcatcgttgacggcggcccgcaggggattattcccgctggcggaacccgcacggtgacgtttacgccgcagcaacgcgccgcgacctgctggattcatccgcacaaacacggcaaaaccgggcgccaggtggcgatgggcctcgccggactggtgctgattgaagatgacgagattcgcaaattgcgcctgccgaaacagtggggtatcgacgatgtgccggtgatcattcaggacaaacgcttctccgccgatggccagattgattatcaactggatattatgaccgccgccgtcggctggtttggcgatacgctgctgaccaatggcgctatctatccgcagcattccgcgccgaaaggctggctacgtctgcgcttgctgaatggctgtaatgcgcgttcgctgaatatcgccgccagcgataatcgtccgctttatgtgatcgccagcgacggcggcctgctggcggagccggtgaaagtcaccgaactgccgttattaatgggcgagcgttttgaagtgctggtggatatcagcgacgggaaagcctttgatctggtgaccctgccggtcagccagatgggaatggcgatcgctccgtttgataaaccgcatccggtgatgcgtatccagccgctgcggattaccgcctccggtacgctgccggatacgttgacgacgatgccggcgctgccgtcgctggaagggctgacggtgcgcaacctgaaactgtcgatggacccgcgccttgatatgatggggatgcaaatgctgatgaagaaatatggcgctcaggcgatgagcggcatggatcatgacagcatgaacgcgcatatgcagggcggcaatatggggcatggcgagatggatcatggcaacatggatcacagcgggatgaatcatggcgcgatgggcaatatgaatcacggcggaaaattcgacttccataacgctaactttatcaacggccaggtcttcgatatgaacaaaccgatgttcgcggcgcaaaaaggccgacatgaacgttgggtgatttccggcgtgggtgacatgatgctgcatcctttccatattcacggcacccagttccgtattttgtcagagaacggcaaagcgccagcggcgcacagaacgggctggaaggatacggtacgcgttgagggcggtatcagcgaagtgctggtcaagttcgatcacgacgcgccgaaggaacatgcctatatggcgcactgtcatctgttagaacatgaagatacgggaatgatgttaggatttacggtctaatcgatgtctgtgacgcaggccgggtaaggcgaaaccgctacccggcacaatgcccggcatacgccgggcattaatggttatttcgcgtcgtcaggcaaagcataggccacgatatagtcgcccatcttcgtaccaaacgaaccgtggcctccggcagaaatgaccacgtactgcttaccgtttacctcataggtcatcggcgttgcctggcctccggcgggtaaacgtccctgccacagtttttccccgttgctcatgttataagcgcgcaggtagttgtcggcggtcgcggcaatgaacagcacgttaccggcggttgagattggcccgcccagcatgggcatccccatgttgaacggcaccggaaccggcatcgggaacggcatactgtcgcgcggcgtccctatacgtttcttccacacgatttcattggtcttcagatccaacgcggaaatgtagccccaggccggttgtttacacggcaaaccaaacggcgaaaggaacggattcagcgtgacgccgaacggtacgccgtactgcggctgaatacccgcttctgtaccggtacctttcgcgtctttcggcggttccattggattacccgggccgcgtgggatcagcttcgagacaaacggcagcgccatcgggttagcgatagcgacctgacggtctggatcgacggaaataccgccccattcaaacatccccaggttgccagggaataccaatgtcccctgctcggatggcggggtgaagataccttcatagcgcaactggtggaacataacgcggcacaccagttggtcgaacatggtcgcgccccacatatccgcgccggagagatcttttttcgggcggaaggttaaatcagagaacggctgagttttggcgacataatcgccttttgccgcgccctgcgggaccggtttttccggagcgggcacgaccagctcgccattacgtctgtccagcacaaagatattaccggttttcgctggtgcatagataaccggaacggtagtaccgtcaacggtaatatccgccagcgtcggctgtgccggcaggtccatatcccacagatcgtgatggacggtctgataactccaggccagtttcccggtggtggcattcagcgccaggatggagctggcataacgttcctgctccggcgtgcggttaccgccccagatatccggcgtggtcacgcccatcggcagatagaccagatccagtttcgcatcataggcggcaggggcccaggagttcggcgagttaaaggtaaaagcgtgctcatcggctggaatcgtgttcggatctttcgccccaggatcgaaggcccacagtagtttaccgctattaacatcaaaaccacggataacgccggacgtttcgcgagtagagaagttatccgtgaccgaaccggcaatgacaattgttttatcggtgataatcggcggcgacgtcggttcatacagtcccggcgtggtatccggcatattggtttgcagattcaggacgcctttgttggcgaaggtttcacacagcttgccggtttcggcattcaccgcgaaaaggcgaccgtcgttgaccgggaggataatgcggctcggacagtcggcgatgacctccggcgaggcggtatccgctttggcctcatgataagagacgccgcggcaggtcacatgctggaaagacgaatcggtcttcaactgaggatcaaaatgccacttctctttaccgctggcggcgtccagcgcgaacagacgctggtgagctgtacacagataaagcgtatcaccgacttttatcggggtcacttcgttggtgatttcacccggatcgttgggttgtttcagatcgccggtgcggaagacccacgcttctttcagttggtgaacgttatccgcagtgatctgtttcagcggcgaatagcgttggccttcctgattacgtccataggccggccagtcttcgtcggcgatcgacgaacttgttgcggcgggcgtggcgtcggcgcgaagcgtaccgttgatctcctgcgggtcgttgaagccagcccaggtcagaatgccgccgctaatcagcagcgccacgaccagcgccgccactgcgccgctggaaggaaccaccagccgatgccagacaaacggcaatattagccagatgccgaaaaacaccaggatatcgctacgcggcgtgagtgcccagaagtcgaacccgacttcccacacgccccaaatcattgtcgccagcagcagggcggcatacagccacagtgcggcacgtttactgcgccatagcaatccggccacaaccagcatcacgaggcccgcgatggggtagtaccaggaaccgccaatagcaaccagccagacacctccgataagaagatacagcccgcaaagtgctgcaaagagggccgtcagcgtcacgagtaatcgtggcgatcgtgcgttattttctgccataaaaagacaccatcccaaattgttaattttttagtagcaattaagcataggaattaacatgtgtgatcgtcatcacaaaatgagctttcttatcaaatgccgcgaatgaatacgtttgctgttatactgcgtgccttgcgcgtcaatgcggcgttattagtcaccggcattgagtgatttgtttttaaatcatatggttataaatatgaaacatactgttgaagtcatgatccccgaagcggagatcaaagcacgtattgccgagctgggtcgtcagattaccgaacgttataaagacagcgacagtgaaatggtgctggtaggtctgttgcgtggctcatttatgtttatggcggacctgtgccgtgaagttcaggttcctcatgaagtcgattttatgaccgcctccagttatggtagcggtatgtccaccacccgcgacgtgaaaatcctcaaagatctggatgaggatattcgtggtaaagacgtgctgattgtcgaagacattattgattccggtaatacgctgtcgaaggtccgtgaaatcctgggcctgcgcgagccgaaatcgctggcgatttgtacgctgctggataagccgtctcgccgagaagtggacgtgccggttgagttcgttggcttttcgattccggacgaatttgtagtcggttacggtatcgactacgcccagcgttatcgccatctaccgtatgttggtaaagtggtgctgctggacgagtaagcgcagaaatgccggatggcgtcgctaaagcgacttatccggcctatagctaatggcttattggtggggaatgtatttcagacttagggcggagatacccttatgatagccgttctccagcgtttctctgttggtggcggtgacgtcaagatcgcgcagcaggccatcattgatactgtacgcccagccgtgaatggtcacattctgcccgcgtttccacgctgactgcataatggtggaatgccccaggttatagacctgctccatgacgttcaattcatagagcgcgtccagacgttgctcttcgggcatttttcccaacagcgagctatgtttaagccagatgtcgcggatatgcagcagccagttattaatcaagcccagctcagggttttctaccgcagccttgataccgccgcaaccggagtggccgcaaatgataatatgctcaacttccagagcatctaccgcatactgaaccacggagagacagttcagatcggtgtgaataaccaggttagccacattacggtgaacaaacaattcgcccggttcaagcccggttaaacgctctgcgggaacgcggctgtcggaacatccaatccatagaaagcgcggtttttgcgcttgcgccagtttctcaaaaaatccggggtcctcttccaccagcatttttgaccatagtgcattgttgctgatgagtgtatctatgtctttcatggaagttaacgacctgtaaccaaataagtgcgttgggctaatatagggcaactccgtaattatttaaaccatatataaagtgtaagaacgtaaagtaagtgagaatttatgaccattgcgctggaacttcaacaacttaaaaaaacctatcccggcggcgttcaggcgctgcgcggcatagatttgcaggtcgaagcgggggatttttacgcgcttctggggccaaatggagcagggaaatcgaccaccatcggtattatcagctcattggttaataaaacgtccgggcgcgttaacgtttttggttacgacctggaaaaagacgtggttaacgccaagcgacagcttggactggtgtcacaggagtttaactttaacccgtttgaaacggtgcaacagatcgtagtgaatcaggcgggttattacggcgtggagcataaagaggcggttttacgtagcgaaaagtatttaaaacagctcgatctgtgggaaaaacgtcatgaacgcgcgcggatgctgtccggtgggatgaaacgccgcctgatgatcgcccgcgcattgatgcatgagcctaaactattgattctcgacgagccgacggcgggcgtcgatatcgaattacgtcgctcaatgtgggggttcctgaaagacttaaacgccaaaggcaccaccattattctcaccacccactatctggaagaggcggaaatgctgtgccgcaatatcggtattattcagcacggcgagctggtggaaaatacttccatgaaaaatctgctttcaaagctgaaatcggagacatttattctggatttagcgcccaaaagcccgctacctaagcttacgggttatcaatatcgtctggtggatacctcgactctggaggtggaagtgttacgcgagcagggggttaacagcgtctttagccaactgagcgagcagggggttcaggtattaagtatgcgtaataaagccaaccgtctggaagaactgtttgtgtcgctggtgcatgaaaaacaaggagatcgcgcatgatgcagctttactgggttgcccttaaaagcatctgggcgaaagagatccaccgctttatgcggatctgggtgcaaacgctggtgccgcctgtcatcaccatgacgctctattttattattttcggtaacctgatcggttcgcgcatcggcgaaatgcatggctttagctatatgcaatttattgtgccgggcctgattatgatggcggtcattactaactcctacgccaatgtggcctcctcgttctttagcgccaagtttcagcgcaatattgaggaactgctggtcgcgccggtgccaacgcacgtgatcatcgccggatttgtcggcggcggcgtggcgcgcgggctgtgcgtggggattctggtgacggcgatttcgctctttttcgtgcctttccaggtgcattcctgggtatttgtcgcgctaacgctgattctgaccgcgattctgttctcgctggccggactgctgaacgccgtgtttgccaaaacctttgacgatatcagtctgatcccgacctttgtgctgacgccgctgacctacctcggcggggtattttactcgctgacgctgctgccgccgttctggcaagggttgtcgcacctgaacccgatcgtctacatgatcagcggtttccgttatggttttctgggtatccatgatgtgccgctggtgacaacgtttggcgtactggtgatctttatcgctactttctatctgctgtgttggtcgctgatccagcgcggacgcggtttgcgtagctgatacgattctcctcttctcctggagggaagaggagacttttgacggctgtcatcattcccgattgatcaccctgataaactacttgcctgctaaggaggtaggttatgttaggttgggtgattacctgccatgacgatcgtgcacaggatatgcttgatcgcctggagagaaaaaatggtccgctggcgcaatgccgggcggtcaatttttggcgcggtctgagctcaaacatgctgagccgcatgatgtgtgatgccctccatgccaccgattccggtgaaggcgtgatatttttaaccgacatttccggcgcggcgccttatcgtgtagcgtcgctgatgagccataaacatcctcaatgtgaagttatttcaggcattagctattcattgatagaggaaatgattcctttgcgagagtcgatgagcagttcagcatttcgtgaccagattgtcgcgcttggcgcgccggatgtcaccagtctctggcatcagcagcagaaaaatccgccttttgtattgctgcatgatttgtatgagttttgatcaataccattgacgacgcttttgctacaataacggcgttttttcgcctcggttatgatatatggttatgcgtgttgttcttatcttgctgttctttttcgccggtaatgtgttggctgccttgcccgctcgttatatgcaaacgacgaaagatgccgccatctggtcgcagattggcgacaaaatggtgaccgtagggaatatccgcgccggacaaattctttccgtaacgcctgttgcggttgattattatgcctttaaatttggcttcggtgtggggtttatcgataaaggccatctgggacccgtgcagggaaaacaaaaagtggaagatgggctgggcgatcttaacaagccgctcagcaatcagaatctggtgacctggaaggacacgccggtgtataacgcgccggacatcagtagcgccccgtttggcgtattggtggataatttgcgttaccccattattagcaagctgaaaggccggctacatcaaacctggaatcagatccgtattggcgacaggctggcttatgtcaacgccatggatgcgcaggaagacaacggcattccgattttgacctatcatcacattttacgtgatgaagagaatacccgttttcgccatacctccaccacgacttcggttcgggcattcagcaaccaaatgacctggcttcgcgatcgcggctatgccacgttgacgatgtaccaactggaggattacatctataaccgcgctaatttcccggcgcgcgcggtggctatcacctttgatgatggccttaaatcggtgagtcgctatgcatatccggtattaaagcagtacgatatgaaagcgacggcatttattatctcatcgcgtattaagcgccatccgcaaaaatggaatcccaggtcgctgcaatttatgagcgtgtccgaattgcgcaagataagcgatgtttttgattttcagtcgcatacccattttttacaccgggtagacgggcatcgccgcccgattttatatagccgcagttaccataatattctgtttgattttgaacgttcgcggcgggcgctcacacagtttactccgcacgtattttatctttcttatccctttggcggctataacgcgaccgcgatcaaagcagcaaaagacgccggtttccatctggcggtcaccacggtgagagggaaggtgaagccgggagataatccgatgctgctcaaaaggctgtatattttacgcacggattcgctggaaacgatgtcgcggctgatagtcaatcagccgcaggggtaaggactatcaggcaacctgaaccggaatggctttcgcggtgcgcttcatttcgttgtcgccttcaaagtaggccactttcggacgccatgtacgcgcttcttcatcagacatggtgacgaagctggcgataatcacaatgtcgccaacttcagcgcagtgcgccgccgcaccgttcaccgagatgattctggagccgcgttcagccgcaatcgcataggttgagaaacgtttcccattggtcacgttccagatatcaatcgcttcgttttccagaataccggaggcatcaaggaaatcctggtcaatggcgcaggagccttcgtagtgcaggtccgcctgcgtgacttttacgcggtggagcttgccttgcagcatggtgcgaatcataacttctataccctgtcgtttatcttggctaagcaggcgcttgtagcctgctttggaaattctcaggcagtattgcccgatttttaacccctgtctactgggctaatgtaacgctttgattatcgatcagacgcgcctgtcccagccaggcggcagccagaatcactgcgcgtttgctggtttccgtcagctccagcagcgtgtcggcatcacggatttgaatgtcgtcggcacggaagcctttttcattcagttcctgctcggcaatggcaataatctcttgcagctcacgattacccgcaatcagtttttcagcgatgctattcatcacgttgtatagacccggcgcaattttgcgctgctctgcagtcagataagcgttacgtgagctgagcgccagaccgtctttagcgcgaataatcggcacaccgacgatctcaatgtcataacccatatccgccaccattttgcggatcagcgccagctgctggaaatctttctcgccaaagcaggcgatatccggctggataaggttgaacagcttgctgacgatggtcgagacgccgcggaagtggcccggacggctggtgccttccagcatggtagagaggccgggaacgtcaacgtatgtctgtccttccagcccctgagggtagatttcctcaacggctggggcaaagacataatcgactttgcgtttgttcagcttttcacaatcttcctgcaacgtgcgcggatagcgcaccagatcgtccggccgatcaaattgcatcgggttgacgaaaatgctgacgatgaccacatcggcccgggcttttgcctcatcgaccagcttcatatggccgtcgtgcaggttgcccatagtgggaaccagtgcgacgcgtttgccttcctgacgcagacggcgaatatgctggcgcagcagcggcagggtttcaatgattaacacaacaagactccttgagttgcttgatgatccagcccgatggcgctgcgcttatcaggcctacatccgttgaggatctgtaggccggataagacgcttcgcgtcgctatccggcacggtcagaaaaattagtgaaagctgtgttcttcgcccggataaacgccggactccacttctgccatatactgccgtacggcggcgcgcatgtcgcccgcctcggcaaggaaatttttcgcgaattttggaatatgaccgccggtgatgccaaacgcatcgtgcatcaccaggatctgaccgtcggtgacgttgcccgcgccgatgccgatcaccggaatcgacagcgcttccgtgacgcgcttcgccagttcaaccggcacgcactccagcaccagcagttgagcgcccgctgcttctaaggccagcgcatcatccagcagtatctgcccggcatcgccgcggccctgaattttatagccgccgaagatattcaccgactggggagttaatcccagatggccacacaccggcacggcgcgttcggtgagcattttcaccgtatcaaccaaccatgcgccgccttcgattttgaccatgttggcccccgcacgcatcacgatagccgcgttttcaaacgcctgttccggcgtggcgtaagccataaacggcaggtcggagagcagcaggcagttcggcgcgccgcggcgtaccgcgcgggtgtggtaggcgatatcttccacggtgacaggcagggtggagtcgtgcccctgaattgtcatgcccagcgagtcgccaaccagcatcacattgatgccttcatcggcgaagagtttggcgaagctgtaatcgtacgcggtaatggtggcgaagcgctttttctcttgtttgcatttctgcagcacagcgatagtagtgggtttgctcataacctctccggccataatattgatgaatagaatggccgcattgtaggggaagagaaccgcaagcgttagccttttctgggcaaattgcgttgcggttcgttataggattttacggataggtgattgaaaattgagcggtggctttgaaatcacctggattgattgttggattgtcaccatcgggctttaaggttgcctggaaatacaacgattttgtcgcgcttcctaccgggctgccgtctccggtgttattggtggtatctttataaattgagcttgagtcgttaggtttgagtaccatctgggcgctcgaactacttttcaaaccttcaattaaaacgccaatgccgctggctttcgtgttgctggttgaattgttggttagtagcgaggtgtttttcgtcccgacattattactggccaatttaacttcaatattattgatgtactggcaggaggagagattgatctggaacttggtcggcgacagcccttccataatctgctttggataaaagctacccagcttaaccgttgatcccgaaacattggtgccgctaatggtgctggccgagcaggttggccagacggccttaagtcctgtggcggcgaggttaaacttcattttatagtttgataatccgctgcccgggttatcaatgtagaaatcggagtcgccgtttttagacagcgtaaagctttgaagctgggcttccgtcggcgcgaagtcagagtcgacataggcatagattttcaggccatacattaatttgccaaggttgctataaacatttgttctggagcaggctgacggaaattccgtgaactcgctggtgatcggcgttgaggtcttatcaaaccagaaggtgcttgaggtcatattctctgctggctgaaggaaggtcatctcaatggtgaaataaaaaccgggaattgaggttttatacagcggatgtccattatagcttttgccagcagagatataattatgggtcagttgaaggtaggtgtggttgccgctgccgttacagaacatctccataacgtactggatgccggaccagttaaaaacggtaatctggcgcagcgccgtttccttatgaatcgcgatggtctgcccaaaattgtggctgttatcagtgaataccgaatccccgcttgggccatcatgttcactggaggcgtagtcgccaacggccagggtagtatttatggcataacagttggacatgatagccatcatcaggaaaaaggcggcaaaccatgttgtgttttttaaaagcatattaacgatatcctttcgtttaataaaatctcctgattattcataggagacattcaccagtacacggctgctaagttcaccggtcgtcactttttcggcactgcgtattttttgcattctggagtaaaaggtccagacggtgtcgctgtaggtgctggcagcaaaagtcgcccgcgatgaaccatccgtattaagcacgttggtgcgtggtgaatcggtggtgaaaatcaccacgccgacattgtctacgccaccagcatcggtagcgatgtcattaggaaaaacttgttgattctcaggtgagaactgcccgtttagtggtgcgaaattaaaggtgacattggttattttaccatcactgatcgggcaagaaataagcttaatggtgaactctttccccccctcataatcggtttccgcggtaatgccatcggcaaaataggcgggcgctatggtggcgaagtttaccgttccattgccatctatctttatctggcaggtgtccttctgcacgctggcggtgaaattcacattggtatcggcgtacagcgtcgcgctaaacagggctgttgccagccctgaaaataacgtggcgagcgtgggttcgcgcaaacgtctcattggtatcaccattactggtaagtgatggtgaaggtggtgggcgagtagaaatctcccgctgtcatattttgaagcgtaccgccgctttgagcgaccatcatagcgcttaaaggaaaatcaacaggcgttgttacacttgcaccagataaatccacggtttgttctggtttcgaccagcagtgaagttttaccgcgccagtgcctccaggggtttctgtcgtccatacttccatggcgaccattgctgcctttgttgttgaagtcgaggcatttgcgaattgcccatcagtgccgctgctccccgggcatgctacattatttggggctagtctgaacttagcttttttatctttgagaccgacacaatcactgaaccgtaacttgaaaagttttattttactttttgcatatacttcagaaatgtaaacgttgccaaaagcgatagtatcggtaatggtatcaccttcaaccacggatgcagaacacgtacccgcagtgatattggcgttcacggtcaggtccagactgttggttccatcggcatatgtcatcgttgatatgccagctcccgtggcaatcagcgagctaaaaatcacgacgcgcaatatttgctttttcattatcatcgtccttgttattgataagtgaagttaaacgtagcggttgagctgaaagcacctgtggtacccgcgccgtcggtcagttcacgcagcgcgaccgtcatttccacttcgtttgctgcgcgctcgtcggaagtccagctaaatgagcctgagccgggcgtgaaataggtttcatcggtagtgcttttgcgcttaaagcccatgccaacattggtggcagcgccgcttgccgctgattggtttttgataaaattgccgctggcatctgtggagctggcaagcgtggtggtgattttggtcagagcggcactgcaatccttcgcgacaaacttaaagtttttctgcgattccgctgatttttttataattttatccaacccgacatcgccgacgttcagcgtatagccgctggtggcatcacccgataagttcgagccatctaacgccgcaattgacatgctgcaggtcgtggctaacacggtggcggtaaagtcgacgttgatattttccgcctgactggtaagcggaaatatcacggcgagcacagaggctgctaaaaggtatttattccttttcattgtctattccatttgatttaaggttattaacacgacaggttatgtggtctaacagtaaggtctggctggaccctaccgtttgttgcgttgccggcaacgcaaaggttgctaaacaagttgctggctggttttcttcaaaccagcgtactgagagttcgcctgcatcgctgatgccgcgaacaaaagcctgaccgccctggcccatgttgtcgatctgcacatcgttctcgtagacttctgcgccaaatggtagggcttttccgtcattacgggacatgttgagaatgaccgagcgtccctggtcagtttcgaaactggctaagactaccgcgccatcacgcggtatcagggttgtactggtgctctttagttcgacatcgttttccagcgtgtcgatatcaatattgacctggttttctctgtaggcggaaagcgagttcgtcgcgccgtagccccagcgatcgatggtgctgttgccgccattgatgcgcgcgcctttcgcgccaggggcttttaccagcacgatggcatcgctattaccgaagttatcgttagtgaacgtcactccaccgccatgcaggacaaagtctccggttgtggcgagcgaatattgtcggctgctgtcattattggcagaggctgaagcagtaacatctccccagggggactgatagctggcgtagccgctgacatcggtgatgttcttttcatttttctgcatggtgtagccggtgttaacgctgtagttcagcgtgtggtcttcactgctgccgttgctgttcatgctcaactggtacccgccgtcaaaatcagtgcgcatttgcgccgtcagtgagctgaaacccgacttacggcgaccgccgcccagcagattctccagcggaacgttgaagttgatatagagcgaatcatctttttcgccatcttcatcccaggatctctggaggttgatactgaggctgccccacgaaaaacctcttccgtaaccgaggctatagtcggtacggctttcattggtagcccagtagtcggtccaggagcctgagaggaaaaaggaaccgtagtcgacttccttaaacctcaacggttggtttatgctgaccgtgacctggtttttcatgcgcgaatagttaagcatggtgttgcgatcgtccgcgtctttatgtttcgcgtcatcaatcagctgtagcgcatcattcaggcccaggtagtcctgcgttgaataacgatatgccgctacgttaaaggaggttgccgtcggttcaatcagcttgttccacgtcagtcggtagctctggcccttataggttttatcctcagggatctctgtacgagactgagtgacatcaagtgcaaatgcgccaagaggggtgttgaggccgacacccagcaacccggcaagatagttattatctgttccctgaacacctgtatagagggtcaaaaagttattaaggccgtagtaatatgaaccttgcgccatatagggcttgtcatgaagctcatcgtcattcacttcaccggcgctgaaatcccaacgtccgacgcccgggcgctgcatctgcataaccgaggagaatggctggctaaaggtgcgtttactgccgtcggcctcctcaacggtgacgatgaggtcgctaccgtagccggaaggactgatgtcgctgatttcaaaggggcctggcggtaccgtggactcataaattttgtagccgccctgggttatgctgaccttggcgttactgtttgctacgccgcgaataatcggcgcatagttggcaagctgcgaaggtagcattcggttgtcgctatacagacgagccccgcgaatgcttacggagtcaaatgtttcgcccgtggtataggtttcaccgacaacaagttgagagcgcattgaaggcagatcgcgctgcaagtagcgattctgatagtcaaaggagcttcctgagtctttcgtccagttatagttgccgttggcgcgaaaacgccatgcgccgaggttaataccggtgttaaacgccgcatacatactgtcattatcggcgctgccattggtgctgtgatagccgttagccgagtaggacagaagcgctgccggaataccatcttcccacagcgaaggctcaacatagccgtcataaccttcaatgagccacgcctgaggtacggtaatatccagacgctgttcgcccatatcaaaattgacctctgaatgcgcgatggcgacgggaaggttcagacaatcttgatcttcttcctccccttttttcagaatttgattggtcgcattgatttctggctgtttgatatgcaactgcgccagatttttttgtgtcaggcaggcttctgcactgaccttgccgatatcgataaagggtatggacaggcttgatacggggttttcgttgacaaaaactttcacgctatacgttccgacaggcgttgggttgccgtcggagtatttgctgatatcgattgtggaggcgctactccccattaaaaaggaactgtcgtattcaacgctttcagcggaaatactgctctggctataaaatagcgcacagcaaactgcgagcatcgttttcttcggcatggccttggaatgtggaaagttttacaccgatttcttcatcctgattcttggttaatccgttacagcgatacggaaccttcaatcaaaccgccaaaatcattaatggcgtgatactccagttttccggcgctagcgcctgacaagcctttcacggtgaaggatgatttactgaaaggcgcaaccatggtggcttcaacgtcataacgtttaccgcctgcagtgtaggtagcgtcattaaatgagacgaaatacggagttgagttatcagcacgtagtaccgcgtagccttgttcgctcgctatttgccacttcagttgttttgccgcttcagcaggctggccttttagtcctgttgggcgatagaacagtttgatacgggtacgaaaagccagttgcagtaagcttttattctcttctttgctggtatccgcttttggcggtacttccagtacgttaaaccagaagacgctttcccggtctttcggcagcgcgctggcctgggtatacataatttttaccgattgcccacgtttaggctcaacgcgtgaaaccgggggggtagaaacgaaaggcgctttaatactcccgggatcgtcgttatcgttacccaggtctatccagttttggactaataatgggcgggtacccttattttccagtcgtatactgacgtcttttttattttcgtcataaacgattctggtgcccgagataataatatccgcatagctaaaggtactaaatacagcactggctaatacgatggcggtcaggcttttttttacatacaacataagcgttccttgcctgtagaagataatgaaatcaactttgaatttaattaaattgaatgaacccccggaatcgttgaaataattcctggaccccgaaggttatatgagatcaataactgataagcacgctaactcaaggaaaggtacgagtacttattagtgataaccgtatgtcctgttactggtaagtaaaggtatacattgcgttcgtggttacatgaccggtagtcacttctttagaagcatcggcacgaacgtaagacgccataaagttataggttgcaactttgtttttgaaggacgcttcatgaatttcagcgccatcgattttaacctgagttttggtatcggcatcatggatggcgatattcacgttttcagccccagtttcaccagccacggacagtgtggtgtcattgtcaagagtgccggtagtgttagagaatgacgaatccattaccagagaagccttagtggcatcagttacatcagccgcgcctgagcaatccaggatgatagagaacggagccggaagcgcgccgtatgcgttagcagcaacgccttcagtgatatcgcctggggctgctgtagtcagatatacgtcaccatcagtcgcttgattaccgcgtgaagaggaaactactttagaacaggttgttgcgctcactaaaccgtggaattcgatctggccgccttcaactgccattgcggaagtagaacccatagccataaccattgcggcagctaaaatcgcttttttcattgctgtatccttacaggattgaaatgttaataaattaaatatctattaatttatattaaatagcagggcttggattttagcgtttgaggataatttttgtataatatttattatttattatttattgttttttgcgatgaattacctctgattatatttaaggatattctgacattttattcattgtgttattaatagtgttattcatggtgtgtatgtttaattgcattaagcggctgttttttaaacggatagctgaaatatatggtttgttactatgttatataatatacgactggttccatgattatttctaacaagagtatttaatttatctaattatacggaataacagcatagaaactatttgttgaattgataataggggtatttcttaccaacgatcgggacagggagacatttgggacatcagctcgatcagcagacctttatcgtcgggaaacaccagctccggagcgatttcgaataacggccacagcataaaaccgcggtttttcatgtcgtagtgcggcacggtcagacggtcggtgttaatgacttcatcgccaaacagcataatgtcgagatccagcgtgcgcggcccccagcgttcgaccttgcgcacccggccctgttgcagctcaatgcgctgggtatggttaagcaattcttcgggggcgagagcggtatccagcgccaccgcagcgttcaggtaatcgggctgatcctgtgggccaagcggcggcgtgcggtaaaacgaagaaaccgcgacgatacggctatcgggaatgtcggcgatagccttcagggcggcattgacctgctccagcggagaggccagattactgccaagcgcgatatacgcgatcgtcatacggtgccctcgcggcgcggcgcgcgtttgcgcggacgtgaacgacggcggcgtggagcaggatcgtcgtccagctcgttgagcatccctttttgttccggcggcgcggaagcctgaaactcggcccaccactgcgccagacgttgcagttcagtattattttccacttgggcgcgcagctccagcaaatcaaacgcggcgcggaatttgggatgttccatcagcttccaggcgcgtttgccctggcgtcgcgacatgcgtaactgaagctgccaaatatcacgggtaagcgtggtaaggcgtttcgggatcgccagtgaacggcaggcttcatccagcacgtcattcatggccagcgcgaaagcatcgtaataggcaaggccgctctcctgagcgattttttgcgccatctccagcagcggataccagaacatggcggcaaacaaaaatgccgggttaacgcgcatctcgttacggatgcggttatccgtattcttcaacacctgcgcaatgatgcgttccattgcgctgtcgccgttttcggtgaaataacgcgtaatggtaggaaacaacggctggaagaggtggtattcccgcagttgttgataggtttcaaaaccgttccccgcctgcaacagcttcagcgattcttcgaacaggcgcgcgggaggaatgtcgtttagcaaggttgccagacgcgggattggctcagccgtttcagggctgatacgcatattgagcttcgcagcgaaacgcacggcgcgcagcattcgaaccggatcttcgcggtagcgcgtttccggattgccgatcaggcgaatcacgccttcttgcagatcctgcatcccgccgacgtaatcgcgcacggtaaaatccgccacgctgtagtaaaggctgttgatggtgaaatcgcggcgctgggcatcttcttcgatagagccgaagatgttgtcgcgcagcagcataccgttttgcccacgctgggaggtcgtacggtcgctttcactgccttcattatgaccacgaaacgttgccacttcgataatttccgggccaaacatcacgtgagccaggcggaaacgacgccccaccagacggcaattgcggaataatttccgtacctgatccggtgttgcgttggtggtcacatcgaaatccttcggctttttaccgagcaggagatcgcggacgccgccgccgaccaggtaggcttcatagcccgctttgttcagcctgtacagtaccttgagggcattttcactgatatctttgcgggagatagcgtgctgttcacgcgggataatcgtcatatgtggacgggcgacggcttgttctgcctcgctctcctcgcggcttaacaccttacggcaaaaattagcgactcgggtaaaaatagcgcacctcggtagtgtcatacattaataagatcaacttactctatgtctttcgcattacggcagacgggcgtaagagagcaacgcgacctgggctgtaagcatcattaacgccgcagcaatgcgaaagacgatgagcaaaaatagcggctaatcatagctcagcgagacgcatttgagaatgccggatttacattagccgatgtgggtacggctgtaagcctccagtgcgccaccgcaaagcgcagcaactcctcaacagacatctcctgccacgctacgacgtcgcgttggcctaaaaagcgcaatgcctggaccagtaccgggcgcggatcgcctgtcgcaagcgcaggggcatgattttgcttggaaagtttagcgccttgttcgttgagcgccagcggaaggtgcacgtaacctggcgcacgccagccaaactgtttatacagcgaaagttgtcggacagtaggttcgattaaatctgcgccgcggacgatctccgtcaccccctgaaaatgatcgtcgaccaccacggccaggttataagcaaacagtccgtcgcggcggtggataataaaatcttcgctagccagctgtgggtcagcctggatgtcgccgcgcaaggcatcatggaaatgcatcactggatgctgctgtttaattctgacggcggcattctccggcccgtggcataacgtccggcaatggccatcgtaaataccgcccagacgttgaatgcgcgagcgggggcaagtgcagtagtagctcagtccctgctcgtgaagccaggccagcgcctcgcgataagcctcatgacgctgtgattgccataagacctcgccatcccagtgcaggccgtaatgttccagctggcgcagaatggtcgctgcggcaccgggaacttcacgtggggggtcgatatcctctatgcgaacgcgccaaactccgcgttgcgcacgggcttgtagatagctgccgagggcggcgattaacgagccgaaatgcagttcgccggatggcgacggcgcgaaacggccaatatagtgtgagtcagtcatgctgcgggcaataaagaataaggcgggaaaactcccgcctgtcataaatagggtagaaacgaacgggattaacccgccatctgtttttcgcgaatttcagccagcgttttgcagtcgatgcacagatcggctgttggacgcgcttccaggcggcggataccaatctccactccgcaggactcgcaataaccgaagtcttcatcttccactttcttcagcgttttctcgatctttttgatcagtttgcgctcacggtcacgattacgtaactccaggctaaactcctcttcctgcgcggcgcgatcgaccggatcggggaagttggcggcttcgtcctgcatgtgcgtcacagtgcgatcgacttcatcccggagttgattacgccatgcttcaagaatacgcttgaagtgcgatagctgggcttcgttcatatactcttcgcccggtttctcctggtacggctccaccccagcgatggcgagaatactcagggacgatgttttacggttttgcccttcttgcatgttgcttctccttaacacgcactatcgatccccatgttcgggggaaaatcaggtcgctataaatagcagatgcttttccggatagcaattatctaaacgtaacacttgacaaccctgtgaggaaaagcgtatttacgcacgcggccagaatacttaataatcaggctgttattccactacaacgttatgggcactggttcgttcagttccatttttgtggctgaaagttctgctttataagctaaaacttccacgcctttattctgagcctcgctcaatagctgcgcgtattttatatcgatatgacgtgcgggggaaaaacgtgtaatggcggagtgcagcacagcgaataccaccaccgcgcgatgacctgccgccgcaacgcccatcaactcccgaagatgtttttgccctcgttcggtgatggcgtcgggaaaataaccgttttctttttccgctaacgtgaccgatttcacttcaatatagcagtccgggcggaaatctgcctgtaacataaaatctatacggctgcgctcggcgccatatttgacttcactattcagaatattgtaccccgccagcgccggcaggcgattctcctgaatcgcttctttcgttagctggttcgcccgcagcgtattcacgcaaatgaatgcgccggattgcgtttcagtcaattcccaggtatgcggatatttgcgtttagtattttctgatgtcgaataccagacggtatcgccaggcgtggcgcagccagtcatcgcgccggtattaggacagtgcagcgtaagcgtcgtaccgtcaggggtgatgacatcagctaaaaaacgtttatagcgctgaatcaacgtagcgcgttgtaaagggggtgagaatagcatcgacattccttgattattattcgcccagcgtccagcgctgcagctcggcatagcgggtacggccttgcccatacgaagaggcgtaaagcgcaaacgatgtgaccggaaatgaccagcaaaagcccggcggcgggatagccaccgtatggctggcgtcgcgcagcagcgtaatatgcgggtgaaaaggctgcgggctttggtaacaaccgctgcgggcggcctgcgcgcgcagcatattagccaactgcaacaacccgcgcggcggctggcgcattcccagccacacaacgcgcgaacgcaaccactgaccggcgtcatctagatgtagcgtaaagcccggttggcgaattcgtccggccagttgcgcaagcgcgcgctgcttatcgttactgacgtcgcctaaaaaggccagcgtcaggtgtaggttcgccgctgccacggggcgtccgtcttcagacgcaaaatgggcggcgcgccaggcgataatttgcgcgcgcgcgtcgtcgggtaagtcaatagcaaaaaacagccgttttggctcagacatagggatactcggttatggattaacacgatgctacaatgcggcgcaaagaaagttaaccccgtggagccgtttgtgacgtcattgcccgttgccgccgtattgcctgaattgttgacagccctaaaaaccgcgccgcaggttttgttgtccgcgcctaccggggcggggaaatccacctggctgccgttgcaactcctgcaacaggggccggttgctggaaaaattctcctgcttgaaccgcgtcgtctggcggcgcgtaatgtcgcccagcgtctggcggaagcgttgaatgaaaagcctggcgaaacggtaggttaccggatgcgcgcgcaaagctgcgtggggccgcgtacccggctggaagtggtgaccgaaggcgtattgaccagaatgattcagcgcgatcccgaattacgcggcgtggggctggtgatactggatgaatttcatgagcgcagtttacaggcggatttagcgttggcgctgttgctggatatccagcaagggctccgtgacgatctcaggctgttaatcatgtctgcgacgctggataacgacaggctttgtcagcgactgcctgatgcgccgacgatcgtctcggaggggcgcgcgtttcccgtggagcgacgttatcagccgcttgcggcgcatttgcgttttgatgaagccgtcgcgatggcgacagcggaactgctgcgcaatgaaaacggttcgctgctgctatttttacccggcgtaggcgaaatacagcgcgttcatgaacatctggcgtcgcgggtagggagcgatgtcctgctttgtccgctgtatggcgcattgtctctggaagcgcaacgcaaagcgattgttcccgcacccgccgggatgcgtaaagtggtattggcgactaacattgccgaaaccagtttgacgattgaagggattcgtctggtcgtcgatagcgctcaggagcgcgtggcgcgattcgacgcgcgaacgggactgacgcggctggttacgcagcgtatcagtcaggcgtcaatgacgcagcgcgcggggcgcgccggacgactggcgccgggtatctgtttacatctgctggcaaaagaacaggcggagcgggcggcggcgcaaagcgatccggaaatcttacacagcgacctctccggtttgttgatggaggtgttgcagtggggatgtcacgatccggcctcgcttttctggctggacaggccgccggaggtgaatcttcaggccgcccgccgtttattattgatgttaggcgcgctggagggcgagcgattaagcgcgcgggggcggaaaatggcggcaacaggtaacgatccgcgcctggcggcgatgttagtcaacgccgacgagggcgacagcgccgccactgccgccatgctcgcggccatccttgaggacccgccgcgaggcggcggtacggatttaagcgtgctattttcgcggcgacagccgggctggcagcagcgtagccagcagcttttaaaacggctgcaggtgcgtaatggcgagccggatagcgcgcttattatgccgctgttggccagagcgtttagcgaccgcatcgcgcggcgtcgcggtcaggaagggcgctatcagttagccaatggtatgggcgcgatgttagatgcggatgacgcgttgggacgtcatgaatggctgatcgcgccgctgttactgcaaggtagcgcctcgccggacgcccgaatattgttggcgcagccgctggatattgcctcgctgattcaggcgtgtcctgatttactgcgccagtccgacacggttgaatgggacgaggcgcagggaacgttgaaagcatggcgcagaatgcgtattggacagttgacggttagcgttcagccactggcgaagccgtctgaagaggagcttcatcaggcgatgctgaacggcatccgcgataaaggtctgtccgtccttaactggacgccggaagcggagcagttccgtctgcgtctgcactgtgcggcgaaatggctgccggaatatgactggcctgccgtggatgaggcgtcgctgctggcgactctggaaaattggttgctgccgcacatgacaggcgtacagtcgttacggagtctgaaatctctgaatgtgactcaggcgttacggggactgcttgactatgccatgctgcaacgtctggatagtgaactgcctgggcattacactgtgccgacgggaagccgaataacgattcgttatcatgaagataacccgcccgcgctggcggtcagaatgcaggaaatgttcggcgaggcaagtacgccgacacttgcgcaggggcgagtgccgctggtgctggaactgctttcgccagcgcagcgaccgctacagattacgcgcgatttaagcgctttctggcagggggcgtatcgcgaagtgcaaaaagagatgaaggggcgttaccccaaacatgtctggccggacgatccggcgaatacggctccaacgcggcgcacgaagaagtattcgtgacgtgttatacgttgcctccaggccggataaggcgttaatcgccatccggcaaaaaggtaaattgagagatttcttcttctgtcgtctggcggaagaatagagaatcgggcctttgcgcctgtatgttgcggagaaaaagcatggcggggaatgaccgcgagccgattggacgtaaggggaaaccgtcacgtcctgtgaaacaaaaggtgagccgtcgtcggcagcatgacgacgattatgatgatgactatgaggatgaagaaccgatgccgcgtaaaggtaagggcaaagggcgtaagcctcgtggcaagcgcggctggctgtggctattgctaaaactgtttatcgtttttgtggtgctgttcgccatttacggcgtctatctggatcaaaaaatccgcagccgtattgatggcaaggtctggcagcttccggcggcggtatatggccggatggtgaaccttgagccagacatgcctgtcagcaaaaacgagatggtgaaattgctggaagcgacgcagtatcgtctggtgacgaagatgacccgtcccggcgaatttaccgtgcaggccaatagcattgagatgatccgtcgtccgtttgacttcccggacagcaaagaagggcaggtgcgcgcgcggctgacgttcagtgacgggcgtctggaaaccatcgtcaatctggataacaaccgccagtttggcttcttccgcctcgatccgcggcttatcaccatgctttcttcgccaaatggcgagcagcgtttattcgtcccgcgcagcggtttcccggatctgctggtcgatacgctgttggcgacggaagaccgtcgtttctatgagcatgatggcattagtctttactctatcgggcgtgcggtgctggccaacctgacggcgggacgcacggtgcagggggccagtacgctgacccagcagctggtgaagaacctgttcctctccagcgaaagatcatactggcgtaaagcgaatgaagcctacatggcgctgatcatggatgcccgttacagtaaagatcgtattcttgagctgtacatgaacgaggtctacctcggtcaaagcggggataatgaaattcgcggttttccgctggcgagcctgtattactttggtcgtccggtagaggaactgagcctcgatcagcaggcgttactggtggggatggtaaaaggggcgtcgatttataacccgtggcgtaacccgaaactggcgctggagcgtcgtaacctagtgttacgcctgttacagcagcagaaaatcatcgatcaggaactctatgacatgctgagcgcgcgtccgcttggcgtacagccgcgcggcggcgttatttcaccgcagccagcgtttatgcagatggttcgtcaggaactgcaggcgaagctgggggataaaattaaagatctctccggcgtgaagatcttcaccacctttgactccgtggcgcaggatgccgcagaaaaagccgttgtcgaaggcattccggcgttgaagaagcagcgtaaattgagcgatctggaaactgcgatggtggtagtggatcgctttagcggcgaggtacgcgcgatggttggcggggcggagccgcagtatgctggctataaccgtgccatgcaggcacgccgttccatcgggtcgctggcgaaaccggcgacctatctgaccgcgttaagtcagccgaacttataccgtctgaacacctggattgccgatgcgccgatttctctgcgccagccgaatggtcaggtctggtcgccggagaacgacgatcgtcgctacagcgaaagcgggaaagtgatgctggtggatgcgttaactcgttcaatgaacgtaccgacggtcaatctggggatggcgttaggtttaccggcggtaaccgatacctggacgaagctcggcgtgccgaaagatcagctcaatccggttccggcgatgctgttaggggcgctgaacctgacgccgatcgaagtggcgcaagcgttccagactatcgccagcggcggaaatcgcgcgccgttatcagcgctgcgttcggttattgcggaagatggtaaagtgctgtaccaaagttatccgcaagctgaacgcgccgtaccggcacaggcggcttacctgacgctctggacaatgcagcaggtcgtccagcgtggtacggggcgtcagcttggcgcgaaatatccgggtctgcatctggtgggtaaaaccgggacgacaaacaacaatgtcgatacctggtttgccggtatcgacggcagccaggtgactatcacctgggtaggccgtgataacaaccagccaacgaaattgtacggtgccagcggcgcgatggcgatttaccagcgctatctggcgaaccagacgccgacgcctttagttctgacgccgccggaagatgtggtggatatgggcgttgattacgacggtaattttgtctgtaacggcggtatgcgcactctgccggtctggacggacgatccaaatacgctgtgccagcagggcgagatgatgcagcagcaacagcagccgtcaggcaatccgttcgatcagtcgtctcagccgcagcagcctgcgcagcaacagccgccgaaagaagagaagagcgacggcgttgccggctggattaaggagatgtttggcggcaattaatcacggtaatagtgccgggtggcgctgtgcttactcggtccacaccgttacgaccccattatgtgcgacgtaggccgaataagacgcttacatcgccatccggcaaatcctccataaataacatttcagtctaatttattaacccttccttttcatctggttgtttcttaaccccttagttttcgtagggccgcgtatcgcttgccattgcgacgatatttcgcctatcatgctgcggttataataataattatcgtttacgttatcattcactttcatcagagatataccaatggcgcgtcttaaaattgctcagccaaactcctcactgcgtaaaatcgcagttgtagtagccacagcggttagcggcatgtctgtctatgcacaggcggcggttcaaccgaaagaagaaaccattaccgtaaccgcagcgcctgcgccgcaggaaagtgcctggggaccggctccgaccatcgccgcgaagcgttccgccactaccaccaaaactgatacatctatcgaaaaaacgccacagtcggtttcggtggtcactaacgaagagatgcagatgcatcaattccagtcagtaaaagaagcgttgggttacacgccgggcgtaactgtaagcagtcgcggcgcttccaatacctatgacttcgtgattatccgtggcttctcttccgtcggcctgagccagaataactatctctggatggcctgaaattgcagggtaacttctacaacgatgcggttattgatccatccctgcttgagcgtgttgagttgatgcgtggcccaacgtccgttctctatggtaagagcaacccgggcggtatcatttcgatggttagcaagcggccgactactgagccgctgaaagaaattcaattcaaaatggggacggacaatttgttccagaccggttttgattttagtgattccctggatgacaacggtgagttctcatatcgtctgacggggctggcgcgctcgacaaatgagcagcaaaagagttctgagtcgcagcgctatgcgattgcgccctcttttacctggcgtcctgatgagaaaacgaattttacgttcctttcttatttccagaacgaaccagagactggctactacggctggctgccgaaagagggaacggttgaaccgttaccgaatggtaaacgcttgccaacagatttcaatgaaggggcgtcaaacaacacctattctcgtaacgagaaaatggtgggatacagtttcgagcatggcttcaacgacacttttaccgtgcgccagaatttacgttttgtcgaaatgaaaaccgcgcaaaaaagcgtctatggcacggggattgcggcggacggccatacgcttaaccgcggtactatcgttgacaacgagcgtttacagaatttcagcgtagatacacaactggaaagtaaattcgcgaccggcgatattgatcatacgttgctgacgggtgtcgatttcatgcgtatgcgtaatgatattaacgcgacgtttggtagcgcgccgtcaatcgatctctataacaattaccatcctgaatactttgctttcggcggcgctgagccgtaccagatgaacgaaagtaaacaaacagccttatatgttcaggatcaggcggaatggaataagtgggtatttactctcggcggccgttatgactggtctaaacaagcgataacggtgcgtcagaattccactacgccgacagaaggatatattgaacgtaatgaccaccagttcacctggcgcggtggcgtaaactacgtattcgataatggaatttcaccttacttcagctatagccaatctttcgagccaagcgccttcgatttgtggagcaccccacgtgtttcttacaagccgtcaaaaggcgagcaatatgaagcaggggtgaaatatgtaccgaaagacatgccagttgttgttacgggtgccgtttatcagctgaccaaaaccaataacctgaccgccgatccaaccaacccattagcgcaggtgccggcaggcgaaattcgtgcgcgaggtgtagagctggaagccaaagcagcattgacggctaatatcaatatgacggcgtcttacacttatactgatgctgaatacacgaaagacactaacctgaaagggaatacgccagagcaggtgcctgaacacatggcgtcgttgtggggcgattacaccttcaacgatggtccgttgtcaggtttaacgctgggaacaggcggtcgttttattggttccagttacggcgatccggccaatagcttcaaggtaggcagcgcagcggtgatggatgcggtcgtcaagtacgatctggcgcgttttggtatggcgggctccagcattgcggttaacgttaataatctgctcgaccgcgaatacgtcgccagctgcttccagacctacggctgtttctggggcgcagaacgtcaggtcgttgcaacggcaaccttccgtttctaatttctttttgggcacggcttgccgtgcccgttttacaagttggctgcgatgcaggaaaaccacattcattccgataccacctttgcgctgcgaagcgtcgcttttcgtgtgccgggccgcacgcttttacaccccctctcgttaacgtttcccgcaggtcgagtcaccggacttatcggccataatggttccggtaaatccacgctgttaaaaatgctgggccgccatcagctgccttccgaaggggatattctgctcgacaatcagccgctggcgagctggagcagcaaggcgtttgcccgcaaagttgcctatctgcctcaacaattgccgcaggcggaaggaatgacggtgcgcgaactggtggcgattggccgctatccgtggcacggcgcgttgggacgctttggcgtcgcggaccgggaaaaagtagacgaggcgattacgctggtcggcttaaaaccgctggcgcatcgtctggtcgatagcctgtccggcggtgaacgccagcgcgcgtggattgccatgctggtcgcgcaggacagccgttgtctgctgctggatgagccgacgtcagcgctggatatcgcccatcaggttgacgtgctggcgctggtgcatcgtttaagccaacagcgcgggctgacggtggttgcggtgctgcacgatatcaacatggcggcccgctactgtgattatttagtagcgctacgcggcggtgaaatgattgcgcaaggaacgcctgcggaactgatgcgcagtgacacgctggaacagatttacggtatcccgatgggtatccttccgcatccggcgggcgccgcgcctgtgagttttgtgtattaatgcgtgagttatatcctcttactcgccgccgtttattaacggcgatggcgctctcgccgctgctgtggcaaatgaatacggcgcaggctgccgctatcgatccccgccggattgtggcgctggagtggctgccggttgagctgctgctggcgctcggtattacgccttatggtgtggcggacgtgccaaattataagctgtgggttagcgaaccgccgttgccggattcggtgattgatgtgggtcttcgcactgaacccaatctcgaactgctgacggagatgaagccgtcgtttatggtgtggtcggcaggttacggaccctcgccggagaaactggcgcggatcgcgccggggcgcgggttcgattttagcgacggcaaaaagccgctggcggtggcccgacgctcgctggttgaactggcgcagacgctgaatctggaagctgcggcagaaaaacatctggcgcaatacgatcgcttcatcgccagccagaagccacgttttatccgccgcgggggacgtccgttactgatgacgacgcttatcgatccgcggcatatgctggtgctcggcccgaattgcctgttccaggaggtgctggacgagtatggcatcgtcaatgcctggcagggtgaaaccaacttttggggcagtacggcggtcagcatcgatcggctggcgatgtataaagaagcggatgtgatctgcttcgatcacgggaatagcaccgatatgaacgcgctgatggcaacgccgctgtggcaggccatgtcgtttgtccgcgccgggcgttttcaccgggtgcccgccgtttggttctatggcgcgaccctctccacgatgcattttgtccgcatcctgaataacgtgttgggaggcaaagcgtgagcagaaaacgtgaaataccggatggcggtgcgaaaaacgccttaaccgacctacggttcgggcgctttgtaggccggataaggcgaagctgccatccggcgttgctgttattggcgctgttggttgccgcctgctggctgacatgggttaacttctccgttgcgctaccgcgcagtcagtggcaacaggctatctggtcaccagatatcgacatcattgagcagatgatttttcattacagccagctgccaagactggcgatttcgctgctggtgggcgcggggcttgggctggtaggcgtcctgttccagcaagtattacgtaacccgctggcggaaccgaccacgctgggcgtggcgaccggcgcgcaattggggatcacggtgactacgctttgggcgattcccggcgcgctgaccacgcagtttgccgccctgacgggagcctgcatcgtcggcgcgctggtgttcggcgtggcgtggggcaaacgtctgtcgccagtgaccctgatcctcgccgggctggtggtcagcctctattgtggcgcaatcaaccagttactggtgattttccaccacgatcagttgcaaagcatgtttttatggagcactggaacgctaacgcaaaccgactggagcggcgtgcagcgtctgtggccgcagttgctgggcggcgtgatgctcacgttattgttgttacgtccgatgacgctgatggggctggatgacggcgttgcgcgtaatctggggctggcgctgtcgttagcgcgtctggcggcgttgtcgctggcgattgtgttgagcgcgctgctggtcaacgcggtgggcattatcggttttatcggcctgtttgcgccgctgctggcgaaaatgcttggcgcaagacgtctgctggcgcgcctgatgctggcgccgctcattggggcgcttattttatggctatccgatcagattatcctttggctaacccgcgtatggatggaagtctccaccgggtcagtgacggcgttaatcggcgcgccgctgctcctatggctgctgccgcggcttaaaagcatgagcgcgccggatatgaacgccagcgatcgtgtggcggcggagcgtcgacatgtcctcacttttgccgttgccggtggcgcgctcctgctgctggcaacatgggtcgcgctctcttttggtcgcgacgcgcacggctggacgtgggcgagcggaacgctgcttgaagaactgatgccgtggcgctggccgcggatactggcggcgttaatggcgggcgtcatgctggcggtggcgggctgcattattcagcgtctgaccggtaacccaatggccagcccggaagtgctggggatcagttccggagccgcgtttggcgtggtgttgatgctgtttttggtgccggggaatgctttcggttggctactgcctgccggaagcctgggcgcggcggcgacactgctgattattatgatagccgccgggcgcggcggtttctcgccgcaacggatgttgctggcggggatggcgctcagcaccgcgtttaccatgctgctaatgatgctccaggcgagcggcgatccgcggatggcggatgtgttgacctggatctcaggatctacctataacgccactggcgggcaggttacgcgaaccgcgatcgtgatggtgattttgctggccgttgtgccgttgtgtcgccgctggttaacgattttgccactgggcggcgatgccgcgcgcgcggtgggcatagcgcttacgccgtcgcgtatcgcgctgctggcgttggcggcttgtttgacggcaaccgcgacgatgaccattgggccgctgagtttcgttggattgatggcgccgcatattgcgcggatgctcggttttcgccggacgatgccgcatatggtcatctcagcgctggcagggggcgttttattggtctttgccgactggtgcggcaggatggcgctatttccgtatcagatcccggcgggactgctttcaagctttattggcgcgccgtactttatctatttgctacgtaaacagagccgctgagtttgccggatggcggcataaacgccttatccggcctgcggtgtagaatgtaggccgggtaagcgtaagcgtcacccggcaattcatcctttacaatttcgcaaacacccgacgcgcggcgtcaatagtattattaatgtcgtccatgctgtgtgcgaccgacataaaacccgcctcaaacgccgatggcgccagatacacgccttcctccagcatcaggtggaagaaacgcttaaagcgttccacgtcgcacgccatcacgtcctgatagcaagttacgctctcagcgtcggtgaagaaaatcccgaacatgccgccgacatggttaaccaccagcggaatattcgcttcttcggcagcttccagcaaaccttccgccaggcgggtggtgagctcatccagcgtttcatgaatgccgggctgggcgacttcattcaggcaggcgaaaccggccgccatcgcaatcgggttgccggaaagggtgcccgcctggtaaaccgggcccgtcggcgccagcgcatccattacatcgcgacgaccgccaaacgcgcctaccggcatcccgccgccgatgattttacccagacaggtcaggtccggcacgacgccgtagtaatcctgggctccggccagcgctacgcgaaaaccggtcattacttcgtcgataatcagcagcgcgccgaactcatcgcacaaggcacgcaggcccggcaggaattccggcagcggcgggacgcagttcatattgcccgccacgggttcgacgatgatacaggcgatttcctgcggatattgttcaaacgccgcgcgcactgacgtcagatcgttataagtgcaggtcagcgtatgtttcgcgaaatctgccggcacgcccggcgagttcggctgaccgagcgtcagcgcgccagaaccggctttgaccagcagacagtctgcgtggccgtggtagcagccttcgaatttgataatcttatcgcggccagtaaaaccacgcgccaggcgaatcgcgctcatcgtcgcttcggtgccggagttcaccatgcgcaccatgtccatggtcggcaccaggttggtcaccagttccgccatttttacttccatttcggttggcgcgccgaagcttaaaccgcgctccgcagcttcgatcaccgcattgcggatagccggatggttatgccccagtaccattggcccccaggaaccgacatagtcgatatatgctttgccatcgacatcgtacagatacgcgccgtccgctttttcgataaacagcggggtgccgcccacgccagtgaaggcgcgaacaggggagttcacgccgccggggatcagctcgcgggccgcgctatagagattttcagacttactcatggaaagattcctggttcgtagaaaaagtgaatacccgctattctaagttattcagagaaggttatgaaagttttacgcatttgaaacaatacgatttgcaggggattttcacggcgttggcgagtagaatgccgactttagatttgtattaccaattaatgatcttctgatgaaaacagacacttccacctttttagctcagcaaattgtgcgcttacggcgcagagatcagattcgtcggttaatgcagcgggataaaacgccgctggccatcctgttcatggcggccgttgtcggcacgcttaccggactggttggcgtcgcctttgaaaagacggtttcctgggtacaaaacatgcgcattggcgcgctggttcaggtcgcggaccatgcgtttttgctttggccgctggcctttatcctttcggcgttactggcgatggtcggctattttttggtgcgaaaatttgcgccggaagccggcggctcgggtatcccggaaattgaaggcgcgctggaggagttacgtccggtgcgctggtggcgcgtgttgccggtgaagtttatcggcgggatgggaacgttgggcgcaggaatggtattagggcgcgaagggccaacggtgcaaatcgggggcaacctggggcgcatggtgctggatgtttttcgtatgcgcagcgccgaagcgcggcatacgttgctggcgaccggcgcggcggcggggctctctgcggcgtttaacgcgccgctggcgggtatcctgtttattattgaagagatgcgcccgcagtttcgctacaacctgatttcgattaaagcggtgtttaccggcgtcatcatgtcgagcattgtgttccgcatatttaacggcgaagcgccgattattgaagtcggcaaactgtctgatgcgccggttaacacgctgtggttataccttatcctcggtattatttttggctgcgtcgggccggtatttaattcgttggtgctgcgtacccaggatatgtttcagcgctttcatggcggcgaaattaaaaaatgggtgcttatgggcggcgcgatcggcggcctgtgcggtattctggggttgattgagccggcagcggcaggcggcggatttaaccttattcctatcgccgcggcaggtaattttagcgtcgggctactgctgttcatctttattacccgggttgtcacgacgctgctttgcttttcttccggcgcgccggggggcattttcgccccgatgctggccctgggaacgctgcttggtacggccttcggtatggcggcggcagtgcttttcccgcagtatcacctggaggccggtacctttgcgattgccgggatgggggcgctgatggcggcgtcggtgcgcgccccgttgacggggattgtgctggtgctggagatgaccgataactatcagctcattttgccaatgattatcacctgtcttggcgcgacactattagcccagtttttgggcgggaaaccgttatactcaaccatcctggcgcgcactctggcgaagcaggatgcggaacaggcggcgaaaaaccagaatgcgcctgcgggcgagaatacttgaacgaattaccagggtattagataatgactgccaatattgggtgaaaatttatccaattaccgatgtcgtttggagcaaaatatgagtgatgacgtagcgctgccgctgcagtttaccgacgcagcagcgaataaagtaaaaagtcttatcgctgacgaagataacccgaatctgaaactgcgcgtgtatatcaccggcggtggttgcagcggcttccagtatggttttacctttgacgatcaggttaacgaaggggatatgaccatcgaaaaacagggcgttggcctggtggttgacccgatgagtttgcagtatctggtgggtggttcggtagattataccgaaggtctggaaggttcccgcttcattgtaaccaacccgaatgcgaaaagtacctgcgggtgtggctcttccttcagcatttgattgctgttcgttgtgccggatggcgacgcgaacatcttatccggcctacaggaaagatgttccaggcccgataagcgtagcgccatcgggcaaaacaatatcaacgtccgttttcatccagggcaaacgtcggcaatttcaaatgccagcgaatggccgccagccgaataaacagcgtgacgaccatgcccatcatgctagcgctttccagcggtactgaaaacgtataaaacgcggtggcgtgaacaatcccgccgataatacaggccgtggcatagatttcggtgcgtaggatcatggggatctcgcgtgccagaacatcgcgaataatcccgccgccgacgccggtaatcacgcccatacagacggccactaatggccccgtttcagcgaggaaggctttattcaccccaatgccgacaaacaccgccagcccgaccgcatccagtaccggcaacatccatttcggcagacgtctcggctggcgaaccagcaggatggtcagcatactggtgaccatggcgacgaccaggtcggtaggatctttaacccagaataccgggccgttatccagcgccatatcgcggattgtcccgccgccgacggcagtaacgacgccgagcaccaggacgccgaacgggtccatacgtaatttcccggccagcaacacgccagagatagcaaatacagccgtgcctacaatatccagccaatagacgagcattgtcgaatccccactaggagcctggtaagacaggctctaattcacctgtgaaagcgcattacagagttgttttgcggcgaggataatacgcgggcttgcgcgttcaaaccagtcgctgttaagcggaataaccggaatttttaacaggtttccccagtattgttcaattttgagaatttcgcccgcttttccggccacgataatggcctggggatgccttgccagcacctgctcacggctgacttgcggccacggcacgcggctgtcagcaaagacgttttctccgccgcaggtcgtcaaaacctgatgttgaatagaccctttaccactggtaaacagaggattcatgccaaactgaagaaagacgcgctttttagctttaccggcatactcgactttgagcgcggcgtactcttttagcaatgtctgcgctgcctgctgagccttttccggctgcgggctccaggcggccagttggcggagcgcgtcggcgatctgttcgatggttaccgcgtccacccacatgaccttaatacctaatgacgtcagttggtttacctggcgttccgcattaccgccgcgccaggcgacgaccagatccggcttcagcgccacaatgcgctccagattcattccctgccaggtagagacctgttctattttttgcgcttcgggcgggtagtcggaatagctgctgacgccaacgggcgtaatctcggcggcaaaagcaagctccgtattggcgggagagagcgtaattacgcgcggcgcagcgtaaagccacaccgggagcgtaagcagcagggcgcccagcgccctgaacatttgcttagccatgcgccagtttctgtaccagcgtttcgaccatcagagtcgactgtttcgccgccaccgcgaggaattcgtcaaagctgaggtgcgattgctgatcggccacgtcagagatagcgcgtaccaccacgaacggcacgttgaagttatggcagacgtgggcgatagcggtggcttccatctctacggcgaccgcgtcggggaagttatgccggattttcgccagcccgacggaaccgttaataaacgcgtcgccgctaacaataaggccgcgtaccgcgttcagattcaactccctgatgcaggattccgcggcggcgatcagcttatcatcggccttaaatccggccggacagcccggtaattgcccgtattcatagccgaaagcggtcacatcagcgtcgtggtaacgcgcttcgtcagagacgacgatatcgccgaccttcagcgtggacgccagaccgcctgcggaaccggtattgatgatcacgtccggcttgcagtgctccagaagcaacgttgcgcccagcgccgccgcgactttaccgataccggatttcagcaacgccacttcggtgccgttcaactggccagtgtaaatttcgcagccgcccagcgtaatcgtctgacggttgtcaattttgtcacgcagcagcgtaacttcttcttccattgcgccaatgatgccgattttcatagatttactcgcgataagtcagttttgggggcatagtttatcatgcgcttatggggaagcgcatttctcaggcggggagaggatatggcatcgatcgatttccgaaataaaattaactggcatcgtcgttatcgttcaccgcagggcgtaaagacggaacatgagatcctgcggatttttgaaagcgatcgcgggcggattatcaactctccggctatacgccgtttgcagcaaaaaacgcaggttttcccgctggagcgcaatgccgcggtgcgtactcgtctgacgcattcgatggaggtgcagcaggtggggcgttatatcgcgaaagagattttaagccgcctgaaagagcaaaaccgactggaggagtacggtctggatgcgctgaccggtccctttgaaagtattgtggaaatggcctgtctgatgcacgacatcggtaatccgccgttcggtcattttggcgaggcggcgatcaatgactggtttcgtcagcggctgcatccggaagatgcggaaagccagccgctcacgcatgatcgctgtgtggtttcctcgctacggttacaggaaggtgaagaaaatctgaacgatattcgccgcaaagtacgtcaggatatctgccattttgaaggtaatgcacagggaattcgtctggtacatacgctcatgcggatgaatcttacctgggcgcaggttggcggaattttaaaatatacccgtccggcatggtggcgagggccggtgccggattcccatcgctatttaatgaagaaaccgggctattatctttctgaagagaagtatattgcgaggttacgtaaagaacttcagttagcgccttacagtcgctttccattaacgtggattatggaagccgcagatgatatttcttattgtgtcgccgatcttgaagacgcggtagagaaaagaatctttagcgttgagcagctttatcaccatttatatcacgcgtggggccaccatgagaaggattcgctgtttgagctggtggtaggaaatgcgtgggaaaaatcacgcgccaatacattaagccgcagtaccgaagatcagttttttatgtatttacgggtaaatacattaaataaactggtgccctatgccgctcagcgttttattgataatttgccgcagatttttgccggtaccttcaatcaggcgttactggaagatgccagcggttttagccgcctgcttgaactctataagaatgtggcggttgaacatgtgtttagccatccggatgtagaacagcttgaactacagggataccgggtgatcagcgggttattagatatctatcagccgctattaagcttgtcgcttaacgactttcgcgagctggtggaaaaagaacggttgaaacgcttccctatagaatcgcgcttatttcagaaactttctacgcgccatcgtttggcctacgtggaagtcgtcagtaaattacccacggattcggcggagtacccggtactggaatattattatcgctgtcggttgattcaggattatatcagcgggatgactgacctttacgcatgggatgaatatcggcgtttgatggcggtcgaacagtaaatggacttttgtaaagatggacaataaatttttactttttccagaaactttattccggaacttcgcgttataaaatgaatctgacgtacacagcaattttgcgttacctgttaatcgagattgaaacacatgaaaaaaaccacattagcaatgagtgcactggctctgagtttaggtttggcattgtcgcctctgtctgccacggcggctgaaacgtcctcttcagcaatgactgcccagcagatgccaagcctggcaccgatgctcgaaaaagtgatgccatcggtggtcagtattaatgtagaaggtagcaccacggtgaatacgccgcgtatgccgcgtaatttccagcaattctttggcgatgactccccgttctgccaggacggttctccgttccagaattctccgttctgccagggcggcggtaacggcggcaacggcggtcaacaacagaaattcatggcgctgggctccggcgtaattattgacgccgcgaagggctacgtcgtcaccaacaaccacgtggttgataacgccagcgtgattaaagtacagcttagcgatgggcgtaaattcgatgctaaagtggtgggcaaagatccgcgttctgatatcgcgctgattcaaattcagaatccgaagaacctgacggcgattaagctggcggactccgacgcgctgcgcgtgggggattataccgtcgctattggtaacccgtttggtctgggcgaaacggtgacgtcaggtatcgtttcggcgctggggcgtagcggcctgaacgtagaaaattacgagaactttattcagaccgacgccgcgattaaccgcggtaactccggcggcgcgctggtgaacctgaacggtgagctgatcggtattaacaccgcgattctggcgccggacggcggcaacatcggtatcggcttcgctatccccagtaacatggtgaaaaacctgacgtcgcagatggtggaatacggccaggtgaaacgcggcgaactggggatcatggggactgagctgagctctgagctggcgaaagcgatgaaagtcgacgcccagcgtggcgcgttcgtcagccaggtgatgccgaattcgtccgcagcgaaagcgggtatcaaagccggggatgtcattacctcgctgaacggtaaaccgatcagcagctttgcggcgctgcgcgctcaggtcggcactatgccggtcggcagcaaaatcagcctcggtctgctgcgtgaaggtaaagcgattacggttaatctggaactgcagcagagcagccagagtcaggttgattccagcaccatcttcagcgggattgagggcgctgaaatgagtaataaaggccaggataaaggcgttgtggtgagcagcgtgaaagcgaactcacccgccgcgcaaattggcctcaaaaaaggcgatgtgattatcggcgctaaccagcagccggtgaaaaatatcgccgagctgcgtaagattctcgacagcaagccgtcggtgctggcgctgaatattcagcgtggtgatagttctatttatttgctgatgcagtaatcacctttgtcccccttccaccacggaagggggcaacacttttctgtgaaactccccacaactccatacttctttgcaccgttttgtgcatttgcacaatgtcgaggcctgtcatcttccttatgcttgtgctctgctcacaggagggatttatggctggctggcatcttgataccaaaatggcgcaggatatcgtggcgcgcactatgcgcatcatcgataccaatatcaacgtaatggatgcccgcgggcgtattatcggcagcggcgatcgggaacgtattggtgaattgcacgaaggcgcgttgttagtgctgtcacagggccgggttgtggatatcgacaacgccgtggcgcgacacctgcacggggtgcgtcaggggattaatcttcccttacgccttgagggcgaaattgttggcgtgatcggtctcaccggcgaaccagagcatctgcgtaaatatggcgaactggtgtgtatgactgccgaaatgatgctggaacagtcgcggttaatgcaccttttggcgcaggatagccgtttgcgtgaagagctggtgatgaacctgattcaggccgaagaaaatacgccggcgctggtggaatgggcacagcgtttagggatcgatttgaaccagccgcgtgtggcggcggtggtggaagtcgacagcggccagcttggcgtcgatagcgcaatggcggaacttcagcagttgcagaatgcgcttaccacgccggagcgtaacaacctgatagccattgtttcccttaccgagatggtggtgctcaaacccgccttaaactcgtttggtcgttgggatgctgaagatcatcgtaagcgcgtagagcagcttatctcgcgaatgaaagagaatggtcagctacgttttcgcgtggcgctgggtaattactttaccggaccgggcagtattgcacgctcataccgcacggcgcgcaccacgatgatggtcggcaaacagcggatgccagaaagccgcagctatttttatcaggatttgatgctgccggtcctgttagatagcctgcgtggcggctggcaggccaatgagctggcgcgcccgctggtaaaactcaaagcgatggataacaacgggttattacgtcggacactgacggcgtggtttcgccataatgtccagccgctggcgacctctaaggcgctgtttattcatcgtaatacgctggaatatcggctaaatcgtatttcggaactgaccgggctggatttgggaaattttgacgatcggctgttgctgtatgtggcgctacaattggatgaacagcgttaagcccggcggcgcttcgcttaccaggcctacggggatatacctgtaggccggataaggcgtaacacgtcgccatccggcaacacacagcttacttacgggtaagcttgtccagatcggcttcgatttcactgatcttattcgcgacgacgctttccagatggcgcaagtcgtcgaggatcttacgtttgagatcgagttctgagcggtcgcgctggcagatttggtccagctcgtcaatcacatagcgtaggttagggctaatctcctgtacttctttataaccctgaccgatgccatcagccaccaccgttttacgctggcgtggatacttaaacttcacgcttttagcaaagaattcacctctatccttttgaaaatagattttcaggatatcgttattggcttcttgccgcaggctgtaacgatcgatttcctcaggattggtaatgcccagactttttagattgtcatacatagcggtatccttcatcacactataacttttgaataattaacgaaaaattggtttttcgccaccaatggatacaaaaaaagcgcggttgatcgcagaagacgtctcggcaacgtcatgagcaaaagggcggcggttattgatagcttaagtaattcaacgcgatattccgtttatagagaaagcgtttgaggtcagtgtgggaaattgaccggaggcagtggtcgataaccttgagaggcggaatctatgtccggaacgtataatgccactattcgccgggtggtgatttccgcctggataggaaactccattgaatattatgattttctattatacggcttagcaagcgcgctggtatttggcccgctttttttcccctggcgccagcccattgactgcaacgttatcttcttttgccagtttcggcgtgggatttatttcccgaccgctgggcgcgctattttttggcaacaggggggatacgcttgggcgtaaaaacacgttattaatcacgttaggcgggatgggcgcggtcacgtttctcatcggttgcctgccttcttacgccagtatcggcgcgctgacacctgctttactggttattctacgttttctacagggatttatggttggaggtgaatggggaggcgccatgttgatggtcgtggaatatgctgctggaaagcaccgggggcggttaagcgcgctatcgcaaacaggaggactcacgggacaattattggcgacaggcgtatttatagtcgtgacccaattaccgcaggaggcgttgttatcgtggggatggcgtattccttttctgctcagtgcgcttttggtgttgccgggattatatatgcgtcatcgtctggatgagacgcctgtcttccgtgcgtttaaaaagcagcaggccattaatcataggcagcaaagggatgaaaggccggtggtcaaagtagtacgagaacaatggcgtagcattttgctgattataattctgcgttttgcggaaagcgttcccttttttcttgctaccgtcttcgcggtttcctgggcgacgacgcagcttgggattgccagcctgactattctgtacattgtaatgttcacctgtctgctggcgtatcccatgcacgtgctatttggcatcatgtcggatcggcgtggctgccgtcaggtgtatattttcggcgcgctttttgtcgcggcaatggcttttccctttttctggctgctggaaagccgttcgctcatactgatgacaatgggctacgttctgcttattaacattggtcataattcactgaatgccgtgcaaccttcttttttcgccggactgtttcatccgcctgtacgctacagcggttcatcaattggcgctcagttgggggcggttgtggcagggggattcacgccgtttatcgctaaagcgttaagcgcagtctatgataacagttggactttggttgccggttatgtcgttttgactgcgctggcttcggcgtttgcggcaaagattgcgccggacaccgtgttaccgcattcgccgtaatgcaaaggggggctgtcgcccccgcttttcactcgcttaatcaatcgtgcgcaataattcgttaatgcccactttaccacgcgttttggcgtcgacttttttcacgatcaccgcgcagtacaaactgtacttaccgtcttttgacggcaggttgccggaaacgaccacggagcccgccggtacgcggccatagtgaacttcaccggtttcgcgatcgtagattttggtgctctggccgaggtatacgcccatggaaatgacggaaccttcttcgacaatgacgccttccacgacttcagaacgcgcgccaataaagcagttgtcttcaatgatggtcgggttagcctgcagcggctccagtacgccgccgatacccacgccgccggaaaggtgaacatttttaccaatctgcgcacaggaacccaccgtcgcccaggtgtcaaccatggtgccttcgtcaacgtaggcgccgatgttaacgtaagacggcatcagcacggtgttgcgggcgataaatgcgccctgacgaacggccgcaggcggaacgacgcggaagccttctttctgaaaacgcgcttcgtcgtaatcagcgaatttcatcggggctttatcgaagtagcggctttccgcaccgtcgataacctggttatcgttaatacggaaagagagcagaaccgctttcttcaaccactggtgagtgacccactgaccgtcgattttttctgcgacacgcagcgcgccggaatcaagtagagaaatgacctgttttaccgcctctcgggtcacggtatctacattagccggcgtaatatcggcgcggcgctcaaaagcggtctcaataacgttctgtaactgctgcattgttaaactctttcatataaataaacacactaccctttatcgtttggattgagggccgctgtcaaccgttgttgcacctcaagttgcagcacattattaagtgcgcgccgatccgctgtggcgattatgaataaatcttctactcgttcaccaatggttgtaattcgggcaccatgaagcgaaattcccagatcggcaaaaatttgtccgaccctggccagcagaccaggttgatcgagcgcgatcaattccatgaatgattttctgtcggtatgggtgggcagaaaattgacttccgtttcgaccgtaaagtgccgtaactttgccggttgccgacgcggctgcggcggctgccagctatgctgcgtaatggtctgttcaagaccggtgcgaataacgtcatggcgatctgccgccagcgggctgccgtctggttccagaacgataaacgtatccattgccatgccgtcgcgagtggtaaagatctgcgcgtcatggacgcttaaattacgcctgtccagctcggcgcagacggcggcaaacagatagggtctgtccggactccagataaaaatttcggttccgccgcgcgtggcttgcggactgagcaacactaacggttggctcagatcgtgctgcaataaatggcgtgcgtgccaggcgagctgatttggactatgacgaacaaaatagttagcgcgacagcgggtccagattttgtgcagcgcggcttcatcaatattgtccattcgcagcagcgccagcgcctgaagctgatggtgacgcacgcgctcacgcatatccggcgtattttgcattccacgcctgagctgtttttcagtggcgaagtacagctcgcgcagcaggctctgtttccagctattccacaaggtttcgttggtcgcgcagatgtccgcgacggtcaggcagaccagaaaacgcagccgtgtttcggtttgcacctcttcggcaaactgcttgatgacttccggatcctggatgtcgcggcgctgagcggtgactgacattagcaggtgttggcgcaccagccaggcgaccagttgcgtttcgcgtgagttcaaaccgtgcagttcggcgaaggtgagtacatcctgcgcgcccagtaccgaatggtcgccgccgcgtcctttcgcaatatcgtggaacagcgcggcgatcaggatcagttccggatggggaagccgcggccagagatcgacgcatagcggatggcgctggcgtgtctcttctttcgcaaagctctccagtttgagcattacgcggatggtgtgttcatccaccgtgtatgcgtggaacaggtcaaactgcatttgtccgacgatgtgcgaccactgcggcatataagcccacagtacgctgtggcgatgcatgggcagcaggccgcggctgaccgcgccgggatggcgtagcatactcagaaacagagtgcgcgcctccgggatgtaacacagcggttggctcaggtggcggcgggcgtggcgcaagtggcgtaacgtcgtagagtagatgccggtgatcgcgctattgcgcaccatcatataaaacatccgcaggatcgcttgcggttcgcggataaacagcgtgtcgtcacgcagatcaatgagcgtgccgcgcagttgaaactcatcgtcaacaggacgtggtttttcatccgcaggcagcgccagaatcgcctcgtcaaatagctgaagcagcatctgattaagttcgctcacccgacgcgtaacccggaagtagtctttcatcatccgctcaaccggatcattgccctcgccgctgtagttaaggcgttgagcgacgcttaactggcggtcgaacagcaggcggttatcgtagcggctgaccaccagatgtagcgcaaagcgaatgcgccacaggatatgcaggcactcgttgagctccgcgcactcagccggggttaaaaagccgaatcccaccatctcatcgagcgaggtggcgccgaagtgacgtcgggcgacccactgcaatgtatggatatcgcgcaggccgccggggctgcttttaatatccggctccagattatagctggtaccgtgatagcgctggtggcgctggttctgctcttctactttggcggcgtaaaatttgtcggacggccaaaaaccttcgctgaaaatatgtttttgtagtgccagaaacagagcgacatcaccgatcagcaggcgcgtttcgatgaggtttgttgcaacggttaaatcagacagaccttccagcagacactcttccagcgtacgtacgctatgcccgacatccagcttgacgtcccaaagtaaagtcagcagctcgccgaccttttgcgcctgttcatcgggcagctttttgcggcttaaaatgagcagatcaatatcggaaagcggatgcagttcgccgcgtccatagccgccgacggcgaccagcgccagatcggcaatctgaccgaaaccggcctcaatccacaggcgttgcaacaactggtcgataaattcggttcgggcttcaataagctgttcagcacaaatgccgctgtcaaatgcctctcccagccagtgttgaaagatgtcgatgcgggctttgataccggcgacggtcagttcagcgcgcggccagacgccagggttttgcggctggtcagggagggtggggagtgcggtattcgcgtgctgttcaggaagagtattcatatgcgccacccattaaaaagccggatggtggcgtgaacgccttatccggcctacgaagtagtacaatttgtaggcctgataagatgcgaaggcatcgccatcaggcaaaacattattcgtcgtgtgtgatgatcgccgggatggtgtcatctttacgcagcgtcagaatttcacagccgttttccgttaccacaatagtatgctcgtactgagcagacaagctgcggtctttggtttttaccgtccagccgtctttcatggtgcggatacggtaatccccggcattcagcatcggttcaatggtaaaggtcatgccaggctgcaacacgacgccaccatcgtctgcatcataatgcagcacctgcggttcttcatggaagccgcgaccaataccgtgtccgcagtattcacgtaccacggagaaaccttcgccttcggcatatttctggatggcggcgccaatggtgcgcaggcggatgcccggtttcaccattttgatgcccagatacaggctctcttgcgtgacgcggcacagacgctcgcccagaatagtcggtttgccgacgataaacatctttgaggtatcgccgtggaattcatctttaatcacggtcacgtcgatgttgacgatatcaccatctttcagatgtttagcgtcatccggaatgccgtggcacaccacttcattaatagagatacagacggatttcggatagccgtggtagccgaggcaggcggagatcgcgtgttgttcgttaacgatgtaatcgttacagatacggtccagttcgccggtggtgacgcccggtttgatatacggttcgatcatttccagcacttcggctgccagacggcccgcgacgcgcattttttcgatgtcttcagatgtcttgatagagatagccatgaattctgtccatcagtgccgatgatttcggcaataattgtgtaagtgctgacaatggtatcagtcaggggtgtaccctgccaaattgagaatcattctgaacttcgcctttcgtgccacaggtgcgttggcgacattttttcaccccagtcacttactggccgtaagctcccggggatgcaaaaatttgccgcctgcctgtaacacgaaattcatcgttcaattcagcactgagtgccaacaattattggtgtcggtggcgtatttgtggtataaagcgtgccggacttccgatccattcgaagactacacacgatggacgggagcgacaaatctcactttgtgtaacaacacacacgtatcggcacatattccggggtgccctttggggtcggtaatatgggatacgtggaggcataaccccaacttatctatagaggttttaaatcatggcaactgtttccatgcgcgacatgctcaaggctggtgttcactttggtcaccagacccgttactggaacccgaaaatgaagcctttcatcttcggcgcgcgtaacaaagttcacatcatcaaccttgagaaaactgtaccgatgttcaacgaagctctggctgaactgaacaagatctctgctcgtaaaggtaaaatccttttcgttggtactaaacgcgctgcaagcgaagcggtgaaagaagctgctaacagctgcgaccagttcttcgtgaaccatcgctggctgggcggtatgctgactaactggaaaacagttcgtcagtccatcaaacgtctgaaagacctggaaactcagtctcaggacggtactttcgaaaagctgaccaagaaagaagcgctgatgcgtactcgtgagcttgagaaactggaaaacagcctgggcggtatcaaagacatgggcggtctgccggacgctctgttcgttatcgatgctgaccacgagcacattgctatcaaagaagcgaacaacctgggtatcccggtatttgctatcgttgataccaactctgatccggacggcgttgacttcgttatcccgggtaacgatgacgcaatccgtgctgttagcctgtacctgggcgctgtcgctgcaaccgttcgtgaaggccgttctcaggatctggcttcccaggcggaagaaagcttcgtagaagccgagtaataaggcttgataactccctaaaatagttcgagttgcaggaaggcggcaagctcgagaattcccgggcgcttacatcagtaagtgtccgggatgagcgagtgaaggcaacgcgcctgcggctcgaaatatgaaggggagagcccttatagaccaggtagtatcacgtttggttagggggcctgtatatggccccctttttcacttttatatctgtgcggtttgatgccgggcagatcaaatctttcgaggattttagaatggctgaaattaccgcatccctggtaaaagagctgcgtgagcgtaccggcgcaggcatgatggattgcaaaaaagcgctgactgaagcgaatggcgacattgagctggcaatcgaaaacatgcgtaagtccggcgctatcaaagcggcgaaaaaagcaggcaacgtggctgctgacggcgtaatcaaaaccaaaatcgacggtaacgtcgctttcattctggaagttaactgccagactgacttcgtggctaaagatgctggcttccaagcatttgctgacaaagtgctggacgccgctgttgctggcaaaatcactgacgtagaagtcctgaaagcgcagttcgaagaagagcgcgttgctctggttgcgaaaatcggcgagaacatcaacattcgtcgcgtcgcttccctggaaggcgacgtgctgggttcttaccagcacggtgcgcgcatcggcgttctggttgccgctaaaggcgctgacgaagagctggttaagcagctggcgatgcacgttgcggcaagcaagccggaattcgttaagccggaagacgtgtctgctgacgtggtagagaaagagtaccaggtacagctggacatcgcgatgcagtccggtaagccgaaagaaatcgcagagaaaatggttgaaggccgcatgaagaaattcaccggcgaagtttctctgactggtcagcctttcgtcatggaaccgagcaaatctgttggccaactgctgaaagagcacaacgctgacgtgactggcttcatccgctttgaagtgggcgaaggcattgagaaagtcgagactgactttgcagcagaagttgctgcgatgtctaagcagtcctgattttcctgaggagccgcctgagggcggcttctttttgcgcctctcttgtaaaatcagccgacgcctggcgtctgcgctgaaatgcgacgtacaatgtcgccggaattaactcatatcaatcgttgacagtctcaggaaagaaacatggctaccaatgcaaaacccgtctataaacgcattctgcttaaattaagcggcgaagctctgcagggtacggaaggcttcggtattgatgcaagcatactggatcgtatggctcaggaaatcaaagaactggttgaactgggtattcaggttggtgtggtgattggcggtggtaacctgttccgtggcgcgggtctggcaaaagcggggatgaaccgcgttgtgggcgaccacatgggcatgttggccaccgtcatgaacggcctggcaatgcgtgatgcgcttcaccgcgcctatgtgaacgcccgcctgatgtcggcaattcctttaaacggcgtgtgcgacaactacagttgggccgaggctattagcctgctgcgtaataaccgtgttgtgattctgtctgcaggtacgggtaacccgttcttcactaccgactctgcggcctgtctgcgcgggatcgaaattgaagcggatgtcgtactgaaagcgaccaaagtggatggtgtattcactgccgatccggcaaaagatccttccgcgaccatgtacgatcagctgacctacagcgaagtgctggataaagagctgaaagtgatggatctggcggcgttcacgctggctcgtgaccacaaactgccgattcgtgttttcaacatgaacaaaccgggcgcgctgcgtcgtgtggtgatgggcgaaaaagaagggacgttaatcacggaataattcccgtgagcgccaaatacgggtaagattctgttctattgacgggtcttattacctggcagaaattaaacgagactatacttagcacatctttatattgtgtgaccgtctggtctgactgagactagttttcaaggattcgtaacgtgattagcgatatcagaaaagatgctgaagtacgcatggaaaaatgcgttgaagcgttcaaaacccaaatcagcaaagtgcgcacgggtcgtgcttctcccagcctgctggatggtattgtcgtagaatactatggcactccgaccccgctgcgccagttggcaagcgtaacggtagaagactcccgtaccttaaaaattaacgtgtttgaccgttctatggggccagccgttgaaaaagcgatcatggcgtcagacctcggtttgaatccaagctctgcgggcaccgatattcgcgttccgctgccgccgctgaccgaagaacgtcgtaaagatctgacgaaaattgtccgtggagaagcggagcaggcgcgtgtcgccgtacgtaacgtccgccgtgatgcgaacgataaagtaaaagctctgctgaaagataaagcgatcagtgaagatgacgatcgtcgctctcaggaagaagtacagaaaatgaccgacgcggcaattaagaaagtggatgcggcgttggcagataaagaagcagaactgatgcagttctgattgatctgtacgcagatataaactcattccaccgctaaacctggcggatgagtggtgtacaaagcgccgcgcagaagacattatcaggtctcctgtgcggcgttttgctttttattccgtttcaacacttctggacgtttcatgaagcaattaaccattctgggctcgaccggctctattggttgcagcacactggacgtggtgcaccataatcctgatagctttcgcgttatcgcgctggtggcgggtaaaaatgtcgcccgcatggcggagcagtgcctggagttctcgccgcgttatgccgtgatggacgatacgtcgagcgcagaacagctcaaaataatgcttcagcagcatggcagccgcaccgaggttctgagcggtcagcaggctgcctgtgagatggcggcgcttgatgaggttgggcatgtgatggcggccattgtgggcgcggctggtttactgccgaccttggcggcgatccgcgcagggaagacgattctgctggcgaataaagaatcgctggtgacctgcgggcggctgtttatggacgaagtgaaacgcagcaacgcccggcttttacccgtcgatagcgaacataacgcgatttttcagagtttgccgcaatctattcagcataatctgggatacgctgaccttgagcaaaatggcgtaacgtcgattttgcttaccgggtctggtggcccgtttcgtgaaacgcccatgtgcgatctggcagcgatgacgccggatcaggcatgtcgtcatccgaactggtcgatggggcgaaaaatctccgtcgactccgccaccatgatgaataaaggtctggaatacattgaagcgcgttggttatttaatgccagcgcacgtcagatggaagtgttgatccatccgcaatcggtcattcattcgatggtgcgttatcaggacggcagcgtcctggcgcagcttggagaacctgacatgcgtacgcctattgcgcatacgatggcatggccgaatcgcgtcacgtccggcgcgcagccgctcgatttttgcaaactcagcgcgctgacgtttagcgcgccagattatcagcgttatccttgcctgaagctggcgatggaggcgtttgagcaaggtcaggcggcaacgacggcgctcaatgcggcaaacgaaatcaccgttgccgcgtttctggcgcaacagattcgttttaccgatatcgccgggctcaatttagcggtgctggagaggatggatttacacgaaccggcaagcgttgatgacgtattgcaggttgacgccatcgcgcgtgaagtagccagaaaacaagtgatacggctctcacgctgacgattatcccgcgacagaagatcgtgctatttgttagcgttgggcttcggtgatatagtctgcgccacctgatcgcaggtttttggcttttttcggtcaggttagccgtggttttacacggcttttttgtggatacacaaaatcattcaggacgcatcgggacggcaggcggatacgttcccggcgtgcgcagacagcgcacgacaggggcgatgacgcgcagtcattcgcgaagcgaaccgaagagaatgtgtataaaggcttcagtattcctgagtaccgctaaatcctttcagggacaaaaaacgcgttatgttgtctgcaactcaaccagtaagcgaaaatttgccagcacatggctgccgtcatgttgccataattatggatggcaatggccgctgggcgaaaaagcaagggaagatccgggcctttgggcataaagccggggcgaagtccgtccggcgagcggtctcttttgctgccaataacggtattgatgcgttaacgctgtatgcctttagtagtgaaaactggaaccgaccagcgcaggaagtgagcgcgttaatggagctgtttgtgtgggcgctggatagcgaagtcaaaagcctgcaccgccataacgttcgcctgcgtattatcggcgatatcagccgatttaactcacgtttacaagaacgtattcgcaaatcagaagcgcttaccgcccataatacggggctaacgttgaatatcgctgcgaattacggcggacgttgggatattgtccagggagtccgacaactggcggagctggtgcaggctggagtgctgcgccccgatcagattgatgaagagagactaggccagcaaatctgtatgcatgagctggcgcctgtggatttagtaattaggactgggggagagcatcgcattagtaactttttgctttggcaaattgcctatgccgaactttactttacggatgttctctggcccgatttcgatgaacaagactttgaaggtgcgctgcatgcctttgctaatcgagagcgtcgtttcggcggtaccgagcctggtgatgacaaagcctgatgggggtcgcttttgctgaagtatcgcctgatttctgcttttgtgttaatacccgcggtcatcgctgcgctttttttattgccgccggtggggttcgccattattacgctggttgtctgtatgctggccgcgtgggaatgggggcagttaagcggtttcgccgcgcgttcacagcgggtttggctggcggtgctgtgtggtctgttattggcgctgatgttatttttgttgcctgagtatcatcacaacattcgtcaaccgctggttgagatgtcgctttgggcatcgttaggatggtgggttgtcgcgctactgctggtgctattttatcccggttcggcggcaatctggcgcaactcaaaaacattgcgtctcattttcggtttgttaactattgtgccatttttctggggcatgctggcgctgcgcgcctggcactatgacgagaatcattacagtggcgcaatatggttactctatgtcatgatcctggtctggggagcggactctggcgcgtatatgtttggtaaattgtttggcaaacataagctggcgccgaaggtttccccgggtaaaacctggcaagggtttatcggcgggcttgctacggctgccgtgatctcatggggttacggtatgtgggcgaatctgaatgttgcgcctgttatcttgctgatttgctctgtggtggcggctctggcttctgtactgggcgacctcaccgagagtatgtttaagcgcgaagcaggaattaaggatagcggccacttgatcccaggccatggcggcattctggaccgaattgacagtctgacggctgccgtaccggtctttgcttgcctgttgttactggtgttcaggacgctctaacggaaggttttatgctgagtattctctggaatctggctgcattcatcatcgcactgggcgtgctgatcactgtgcatgaatttggtcatttctgggttgcccggcgctgcggtgtgcgagttgagcgcttttccatcggttttggcaaagcgctctggcgtcgtaccgatcggtacggcaccgagtatgtcatcgccctgatcccgctgggcggctacgtcaaaatgctggatgagcgcgccgaaccggtagcgccggaattgcgtcgtcacgccttcaataacaaaacggtgggccagcgcgccgcaattattgccgcaggtccggttgcgaacttcatttttgctatctttgcttactggctggtctttatcatcggcgtccctggcgttcgtccggtcattggcgaaataacgcccaactcgattgctgcgcaggcgcaaattgcgcctggtacggaacttaaagccgttgatggtatcgaaacccctgattgggatgccgtgcgtttacaactggtgtccaaaattggcgatcagcagacgacggtgagcgtcgcgccgtttggcagcgaccagcggcaggacaaaacgcttgatttacgtcactgggcatttgagcctgataagcaagatcctgtatcttctttagggattcggccccgcgggccacagattgaaccggtactgtcagaagtgcaggcgaattccgcagccagtaaagcgggtttgcaagcaggcgacaggatcgttaaagtcgatggtcagccgttaacgcagtggatgaaattcgtgacgtttgtacgtgataatcccggtaagccgttagcgttagagattgaaaggcaggggagcgccttgtcgttgacgttaacgccggatacgaaatcggttaacggaaaggcggaagggtttgcaggcgtggtgcctaaaattattcctctgccggaagagtacaagactatacgccagtatgggccttttagcgccatcctcgaagccacggataagacgtggcagttgatgaagctgacggtcaatatgctgggtaaattgataaccggtgatgtgaaactgaacaacctcagtgggccgatttctatcgctcagggggctgggatgtcagcggagttcggggtgatttattacctgatgttccttgcgctaatcagcgtgaacttagggataattaacctgtttccgctgcccgttcttgacgggggtcatctgctgttcctggcgattgaaaagcttaagggcgggccggtatccgagcgggttcaagactttagttatcgcattggctcgattttgctggtgttgttaatggggcttgcacttttcaatgatttctctcggttgtaagagagttagttaggaagaacgcataataacgatggcgatgaaaaagttgctcatagcgtcgctgctgttcagcagcgccaccgtatacggtgctgaagggttcgtagtgaaggacattcatttcgaaggcctgcagcgagtcgccgttggtgcggctctcctcagtatgccggtgcgcacaggcgacacggttaatgatgaagatatcagtaacaccattcgcgctctgttcgccaccggcaactttgaggacgtccgcgtcctgcgcgatggtaatacccttctggttcaggtaaaagaacgtccgaccattgccagcatcactttctccgggaacaagtcggtgaaagatgacatgctcaagcaaaacctcgaagcgtctggcgtacgtgttggcgagtctctggatcgcaccacgctgtctgatatcgaaaaaggtctggaagacttttactatagcgtaggtaaatacagcgccagcgttaaggcggtcgtcacgccgctaccgcgcaaccgtgttgatcttaaactggtgttccaggagggcgtatcggcgaagatccaacagatcaacatcgtcggtaaccatgcctttagcaccgaagaactcatttctcatttccagttgcgtgacgaagtgccgtggtggaacgtcgtcggcgatcgtaaataccagaaacagaagctggcgggcgaccttgaaaccttgcgcagctactatctggatcgcggctacgcgcgtttcaatattgactccacgcaagtgagtctgacgccggataagaaagggatctacatcaccgtcaatatcaccgaaggcgatcagtacaagctttccggggttcaggtgagcggtaacctggccggacattccgctgaaattgagaaactgacgaaaattgaaccgggcgagctctataacggcaccaaagtgaccaaaatggaagatgacatcaaaaagcttctgggtcgctatggttacgcctatccgcgcgtgcagtcacagcctgaaattaacgatgctgacaaaaccgtaaaactgcgcgtgaacgtcgatgcgggcaaccgtttctacgtgcgtaagatccgctttgaaggcaacgatacctcaaaagattccgttctgcgccgtgaaatgcgccagatggaaggggcgtggctgggcagcgacctggttgaccaggggaaagagcgtctgaaccgtctcggcttctttgaaaccgtcgacaccgacacgcagcgcgttccggggagcccggatcaggttgatgtggtgtacaaggtgaaagagcgtaacaccggtagcttcaacttcggtatcggttacggtacagaaagcggcgtgagcttccaggccggcgttcagcaggacaactggttaggtaccggttattccgtggggattaacggtaccaaaaatgactaccagacctacagcgaactgtccgttactaacccatactttaccgttgacggcgtgagcctcggtggtcgtatcttctataacgactttgaagcggatgatgccgacctgtccgactataccaacaagagttacggtacggatgtgacgcttggcttccccatcaacgagtacaacacgttgcgtgctggtctgggctatgtccataacaaactgtccaacatgcagccgcagatcgcgatggatcgttatcttgaatcgatgggcgaccctgatgccagcgattttgccgctgacgacttcacctttaactacggctggacctataacaagcttgaccgtggttatttcccgacggacggctcgcgagtcaacctgacgggtaaggtgacgattccaggttccgacaacgaatactacaaagtgtcgctggataccgcgacctatgtgcctattgataacgaccacaagtgggtggttctggggcgtactcgttggggttacggcgatggtttaggcggcaaggaaatgccgttctatgagaacttctatgccggtggttccagtaccgtgcgtggtttccagtcgaatactatcggcccgaaagcggtctataaaaatggcgcccacactagttgggacgatgatgatgattacgaagactgtactcaggaatcaggctgtaaatcagatgatgcggtaggtggtaatgccatggctgtcgccagcctggaatttattaccccgacgccgttcatcagcgaaaagtatgccaactcggttcgtacctccttcttctgggatatgggtaccgtttgggatacgaactgggatccgtcatctgcgccgtcagatgtaccggattacagcgatccaggcaacatccgtatgtccgcgggtatcgcattacaatggatgtccccattggggccgttggtcttctcctacgcccagccgtttaaaaagtacgatggagacaaagccgagcagttccagtttaacattggtaaaacctggtaattgttcactgcaaaggaatgcattggtagtgtagcgatgacttttggcgatgcccccagggatcgccaggccacgcaaagagctgtaccttcgggtgcaaatgggatggtaaggagtttattgtgaaaaagtggttattagctgcaggtcttggtttggcgatggttacgtccgcacaggctgctgacaaaattgcaatcgtcaacatgggtaatctgttccaacaggttgcgcagaagacgggtgtatccaatacactggaaaacgaatttaaaggccgtgcggctgaactgcaaaaaatggaaaccgatctgcaatctaaaatgcagcgtctgcaatccatgaaagcaggtagcgatcgtactaagctggaaaaagacgtgatgtctcagcgccagactttcgcacaaaaagcgcaggcttttgagaaagatcgcgctcgtcgttccaacgaagaacgcaacaaactggtgactcgtatccagactgcggtgaaaaaagtggctaacgaccagagtatcgatctggtggtagacgcaaacaccgttgcttacaacagcagcgatgtgaaagacatcaccgctgacgtactgaaacaggttaaataagtaatgccttcaattcgactggctgacttagcagaacagttggatgcagaattacacggtgatggcgatatcgtcatcaccggcgttgcgtccatgcaatctgcaacaacaggccacattacgtttatggtaaatcctaagtaccgtgaacacttaggtttatgccaggcttctgcggttgtcatgacgcaggacgatcttccttttgccaagagcgcggcgctggtagttaaaaatccctacctgacctacgcgcgcatggcgcaaattttagatactacgccgcaacccgcgcagaatatcgcgccaagcgccgtgattgatgcgacggcaacgctgggtagcaatgtttcagtcggcgcgaatgcggtgattgaatctggcgtacaactgggcgataacgtggttatcggcgcaggctgtttcgtcggaaaaaatagcaaaatcggggcgggttcacgcttgtgggcgaacgtaacgatttaccacgacattcagatcggtgagaattgcctgatccagtccagtacggtgatcggcgcggacggttttggctacgctaacgatcgtggcaactgggtgaagatcccacaactgggccgggtcattattggcgatcgtgtcgagatcggcgcttgtaccaccattgaccgtggcgcgttggatgatactgttattggcaatggcgtgattattgataatcagtgccagattgcacataacgtcgtgattggcgacaatacggcagttgccggtggcgtcattatggcgggtagcctgaagattggccgttactgcatgattggcggcgccagcgtgatcaatgggcatatggaaatatgcgacaaagtcacggtaactggcatgggtatggtgatgcgtcccatcacggaaccgggcgtctactcctcaggcattccgctgcaacccaacaaagtatggcgtaaaactgctgcactggtgatgaacattgatgatatgagcaagcgtctcaaagcgattgagcgcaaggttaatcaacaagactaacgttccgccttgtagttgccattcttttccggcctgtcacattcatacgattgcggcaggccgtgttattattgcctttttgtatatttggacaggaagagtattttgactactaacactcatactctgcagattgaagagattttagagcttctgccgcaccgttttccgtttttactggtcgatcgcgtgctggactttgaagaaggtcgttttctgcgtgcggtgaaaaatgtctccgtcaacgagccgtttttccaggggcatttcccgggcaaaccgattttgccaggcgtgctgattctggaagcgatggcgcaggcaaccggtattctggcgtttaaaagcgttggtaaactggaacctggcgaactgtattatttcgcgggtattgatgaagcgcgctttaagcgtccggtggtgccaggcgatcagatgatcatggaagtcactttcgagaaaacgcgccgtggcctgacccgctttaaaggggttgcgctggtcgacggtaaagttgtgtgcgaagcaaccatgatgtgtgctcgtagccgggaggcctgattcgtgattgataaatccgtctttattcatcctaccgccattgtggaagacggcgctgtaattggcgctaatgcccacattggtcccttttgtattgttgggccgcaggtcgaaattggtgagggaaccgtactgaagtctcatgtggtcgtaaatggtcaaaccaaaatcggccgcgacaacgagatttatcagtttgcctccatcggtgaagtgaaccaggatctgaaatatgcgggtgagccaacccgtgtggaaattggcgatcgtaaccgcatccgcgaaagcgtcaccattcatcgtggtacagtgcagggcggtgggttgacgaaggtgggtagcgataacctgctgatgatcaatgcgcatgtcgcacatgattgtacggtaggtaatcgctgtatcctcgccaacaacgccacgctggcggggcacgtatcagtcgatgattttgcgatcatcggcggtatgacggcagttcatcaattctgcattatcggtgcgcatgtgatggtcggcggctgctccggcgtggcgcaggatgtccctccgtatgtgattgcgcagggtaaccatgcgacgccgttcggggtaaatatcgaagggctgaagcgtcgcggctttagccgtgaagggctggtggcgattcgtaatgcctacaaactgttgtaccgcagtggtaaaacgctcgacgaagcgaagctggaaatcgctgaacttgctgaaaagcatccggaagtgaaggcgtttaccgagttctttgagcgttcaacgcgcggtccgattcgttaatggcggcacagcgtcctttaacgattgccctggtcgccggtgaaacgtccggcgatattcttggcgcaggcttaattcgtgcgctgaaagcgcgcgtacccaacgcccgttttgtgggcgttgcggggccgcgtatgcaggccgaagggtgtgaagcctggtacgagatggaagagctggcggtcatgggcattgttgaagtgctcggacgtttacgccgtttgttgcatatccgcgccgatctgacccgccgttttaccgaactcaagcccgatgtctttgtcgggattgatgcccctgatttcaatattaccctcgaaggtaatctgaaaaaacaagggattaagaccattcattatgtcagcccgtccgtttgggcctggcgacagaaacgcgttttcaaaataggcagatccacccatatggtgttggcttttctgcctttcgaaaaagcgttttacgataaatttaacgtcccgtgccgctttatcggtcacaccatggcggatgccatgccgctggacccggataaaaatgcggcgcgcgacgtgctgggtatcccgcatgacgcccattgtctggcgctactgccaggcagccgtggcgcggaagtggaaatgctcagcgccgacttcctgaaaaccgcacaattgctgcgacagcgctatcccgatctggaagtggtagtgccgctggtgaacgcgaaacgccgcgagcagtttgaaaaaattaaagcggaggttgcgccggatctcgccgttcatttgctggacggcatggcgcgcgaggcgatgatcgccagcgacgcggcgttgctggcctcaggcacggcggcactggagtgtatgctggcaaaatgcccgatggtagtggggtatcgtatgaagcccttcactttctggctggcgaaacgtctggtgaaaacggagtatgtgtctttgcctaacctgctggcgggaagagaattagtcaaagagctgttgcaggaagagtgcgaaccgcaaaaactcgccgaagcgctgttgccgctactggcgaacggtaaaaccagccatgcgatgcacgacaccttccgtgaattgcatcagcagatccgctgtaatgccgatgagcaggcggcagatgccgtcctggagttagcacaatgatcgaatttgtttatccacacacccatttagtggcgggtgtggatgaagtgggccgtggcccgctggtgggcgccgtagtgaccgccgccgtgatcctcgatccggcgcgtccgatcgtcggtctgaatgattccaaaaaattgtctgaaaagcgtcgtctgtcattgtatgacgagattaaagaaaaggcgttaagctggagtctgggacgcgcggaagcgcatgaaattgatgagctgaatattttgcacgccaccatgctcgccatgcagcgcgctgtcgctggtctgcatattgcgccagaatatgtgctgatcgacggcaatcgctgtccggagctgcctgtgccgtcaatggccgtggtgaaaggcgacagccgcgtggcggagattagcgcggcgtctattctggcgaaagtcacccgcgacgcagaaatggcggcgctggatatcgtttttcctcagtatggctttgcgcagcacaaaggctatccaaccgcttttcatctggaaaagttggcccagtatggcgcgacggcgcaccaccgacgcagttttgcgcctgttaaacgcgctctgggacttgtgtcctgattcttgtatcgagaaatctgaagatgtctgaaccacgtttcgttcacctgcgggtgcacagcgactactctatgatcgatgggctggcgaagaccgggccgctggtgaaaaaggcggcctcattaggtatgcctgcgctggcgatcaccgattttaccaacctctgcggtctggtgaagttctacggagcgggtcatggcgcgggcattaaacccatcgtcggggcggactttaacgttcacaacgaactgctgggagatgagctgactcatctgacggtactggcggcgaataatacgggataccagaacctgacgttgctgatctcgaaagcgtatcagcgcggctacggcgcggcaggcccgattatcgagcgcgactggctggtagagcttaaagaaggtttgatcctgctttccggcgggcgcatgggcgacgtaggccgctgtctgctacgcggcaaccaggcgctggtggaggagtgcgttgctttctatgaagcgcattttcccgatcgctacttcctggaactgatccgtaccggcagacaggatgaagagacctatctccatgctgcggttgagctggctgaggcacgtggtttgccggttgtcgcgacaaacgatgtccgtttccttgaaagcgatgattttgacgcccatgagattcgtgtcgcgattcacgacggtttcacgctcgacgatcctaaacgtccacgcaattattcaccgcagcagtatatgcgcagtgaagaagaaatgtgcgagctgttctccgatattccggaggcgctggaaaatacggtggagattgccaaacgctgcaacgtaacggtgcgtctgggtgaatatttcctgccgcagttcccgaccggcgatatgaccaccgaagattatctggtcaaaaaatcgaaagaggggctggaagagcgtctggctttcctgtttccggacgaagaagagcgcaaaaagcgtcgcccggaatatgacgagcgtctggatattgaactacaggttatcaaccagatggggttccctggctacttcctcatcgtgatggagtttatccagtggtcaaaagataacggcgtgccggtagggccgggacgtggttccggggccggttcgctggtggcctacgcgctgaaaattaccgaccttgatccgctggaatttgacctgctgttcgaacgtttcctgaacccggaacgtgtctcgatgcctgacttcgacgttgacttctgtatggagaaacgcgaccaggtgattgagcacgtcgcagacatgtacgggcgtgatgcggtatcgcagattatcaccttcggtacgatggcggcgaaagccgttatccgcgatgtgggccgcgtgctggggcatccgtacggttttgtcgatcgtatctcgaagctggtgccgcccgatccgggcatgacgctggcaaaagcctttgaagcggaaccgcaactaccggaaatttacgaggcggatgaagaggtcagagcgctgatcgatatggcgcgtaagctcgaaggcgtcacgcgtaacgccggtaagcacgctggcggcgtggtcatcgcgccgaccaaaattaccgactttgcgccgctgtactgcgatgaagagggcaagcatccggttacccagtttgataaaagcgacgtggaatatgccgggctggtgaagttcgacttcctcggtttgcgtacgctgactatcatcaactgggcgctggagatgatcaacaagcggcgggcgaagaatggcgagccaccgctggatatcgccgccattccgctggacgataaaaaaagcttcgacatgctgcaacgctcggaaaccacggcggtcttccagcttgaatcgcgcggtatgaaagacctgatcaagcgtctgcaacctgactgctttgaagatatgatcgcgctggtggccctgttccgtcccggcccgttgcagtcagggatggtagataactttatcgatcgtaagcacggtcgtgaagaactctcttacccggacgttcagtggcagcatgaaagcctgaagccggtactggagccgacctacggcatcattctgtatcaggaacaggtgatgcagattgcccaggtactttccgggtatactctcggtggcgcggatatgctgcgtcgtgcgatgggtaagaaaaagccggaggagatggccaaacagcgttccgtttttgaagagggcgcgaaaaagaacggtatcgacggcgaactggcgatgaaaatctttgacctggtggagaaattcgccggttacgggtttaacaaatcgcactccgccgcttatgcgctggtttcttatcagacgctatggctaaaggcgcactatccggctgaatttatggcggcggtgatgactgccgatatggacaacaccgagaaggtcgtcggcctggtagacgagtgctggcggatgggactgaaaattctgccgccggatattaactccggattgtaccatttccacgttaatgatgagggcgagatcgtctacggcatcggcgcgatcaaaggcgtcggcgaagggccgatcgaagcgatcatcgacgcgcgtaatcagggcggctatttccgcgaactgtttgatctgtgcgcgcggaccgacaccaaaaagctcaaccgccgggtgctggaaaagctgatcatgtccggggcgttcgaccgcctggggccgcaccgcgccgcgctgatgaactcattgggcgatgcgctgaaagccgccgaccagcacgccaaagcggaagctatcggtcaggcggatatgttcggcgtactggcggaagagccggagcaaatcgaacaatcctatgccagctgccagccgtggccggagcaggtggtgttagatggggaacgtgaaacgttggggctgtacctgacgggccaccctatcaatcagtatttaaaagaaattgagcgctatgtcggcggggtaaggctcaaagacatgcatccgacagaacgtggtaaagtcaccacggctgcggggctcgtgattgccgcaagggttatggtcaccaagcgcggcaatcgtatcggcatctgtacgctggatgaccgttccgggcgtctggaagtgatgttatttaccgacgcgctggataaataccagcagttgctggaaaaagaccgcatacttatcgtcagcggacaggtcagctttgatgacttcagcggggggcttaaaatgaccgcccgcgaagtgatggatattgacgaagctcgcgaaaaatacgctcgcgggcttgctatctcgctgacggacaggcaaattgatgaccagcttttaaaccgactccgtcagtctctggaaccccaccgctcggggaccattccagtacatctctactatcagagggcggatgcgcgtgcgcggctgcgttttggcgcaacgtggcgtgtctctccgagcgatcgtttacttaacgatctgcgtggcctcattggttcggagcaggtggaactggagtttgactaatacaggaatactatgagtctgaatttccttgattttgaacagccgatagcagagctggaagcgaaaatcgattctctgactgcggtaagccgccaggatgagaaactggatattaatatcgatgaagaagtccatcgcctgcgcgaaaaaagcgtagaactgacgcgcaaaatcttcgccgatctcggcgcatggcaggtagcccaactggcgcgccatccgcagcgtccgtacaccttggattatgtccgtctggcgtttgatgagtttgatgagctggcgggcgatcgcgcctatgctgatgacaaagccatcgtcggcggtatcgcgcgtctggaagggcgaccggtgatgatcattggtcatcagaaaggtcgtgaaaccaaagaaaaaattcgtcgtaactttggcatgccagcgccggaaggctaccgcaaagcgctgcgcctgatggaaatggctgaacgcttcaacatgccgattatcaccttcatcgacaccccgggcgcttaccctggcgtgggcgcggaagagcgtggtcagtctgaagctatcgcccgcaacctgcgtgagatgtctcgtctgaacgtaccggtcatctgcaccgtgattggcgaaggcggctccggcggcgcattggcgattggcgtgggtgataaagtgaatatgctgcaatacagcacctattccgttatctccccggaaggttgcgcctctattttgtggaagagcgccgacaaagcgccattggctgctgaagcgatgggcatcatcgcgccgcgtctgaaagagctgaagctaatcgattccatcattccggagccgctgggcggcgcgcaccgtaatccggaagcgatggcggcgtcgctaaaagcgcagctgctggaagatttagccgatctcgatgtgttaagcaccgatgatttaaaaaaccgtcgttaccagcgtttgatgagctacggttacgcctaatcatttacctcatttctcccaggaggccggataatccggcctcttttttgtctatggaaaaccccagctaggctgggggttccggaaagctttcagctttaagccagttattaaaaccccttttgatttgttaaaacatcttgcggtctggcaactgcaaaagttcaacaagaaatcaaaagggggtcccaatgggggacgaaaagagcttagcgcacacccgatggaactgtaaatatcacatagttttcgcgcccaaataccgaagacaagcgttctatggagagaagcgtagggcagtaggcagcatattaagaaaattgtgtgaatggaaaaacgtacgaattctggaagcagaatgttgtgcagatcatattcacatgcttctggagatcccgccgaagatgagtgtgtcgagtttcatgggatatctgaagggtaaaagtagtctgatgctttacgagcagtttggggatctaaaattcaaatacaggaacagggagttctggtgcagagggtactatgtcgatacggtgggtaagaatacggcgaagatacaggactacataaagcaccagcttgaagaggataaaatgggtgagcaattatcgatcccgtatccgggcagcctgtttacgggccgtaagtaacgaagtttgatgcaaatgtcagatcgtatgcgcctgttagggcgcggctggtaagagagccttacaggcgcatcagaaaaacctccggctatgccggaggatatttattttggacgaggaaaaatgagacgccgatgagctgatgtgattaaacgcaacggcatgttctccctgacactgtagcaactgccaggcgtgtggccagggcaggcagtgaactacccttcaaggagaaaattatgggattgcaaaaaacactggcgctcagcgccgtagcggcagggatcatgttgagcttatccggtgcgcaggccgcgccgctgcttagcagtagtgagccaatgaccattaacgccagcgatctggcggcgaaagagaaagcgctgacggattttccgttaatggaggcagtgaaatcctctatccagacgttggataacagcgcggtcgaacaaatcgaaccggggcgcgccgctaacccggcaaacgtaaaacgcgttgaaagtattctgaaagaggccgaccgggattatctgttcccgatgcgcgcgccggaatacacttactctaacttcctgaaagcgataggtaaattcccggcggtttgtggtacctacaccgatggacgcgatagcgacgctatctgccgtaaaaccctggctactatgtttgcgcattttgcccaggagacgggcggtcacgaaagctggcgtgacattccggaatggcgtcaggcgctggtctatctgcgcgaagtcggctgaacagaagggcaaaaaggcggctacaacggcgaatgtaacccggatgtatggcagggccagacctggccgtgcggtaaagataaggacggcgatttcctcagctattttggccgcggggcaaaacagctttcttataactacaactatgggcctttctctgacgcgatgtatggcgacgttcgccctctgctggataaacccgagctggtggcggatacctggatgaacctggcgagcgccgtcttcttctttgtgtatccgcagccgccgaagccgtctatgctacatgtgattgacggtacctggcagccaaacgatcgcgataaagcaaacggcctggtatcaggtttcggcgtcactattcagatcatcaatggcggcgtggagtgcggcggcgcagatgagaatgcgcagtcgcttaaccgtatcgcctactacaaagagtttgccaactacctgaaagtgccggtgccggctgacgaagtgttgggctgtaaaaagatgaagcagttcgatgaaggcggcgctggcgcgttaccgatctattgggaacaagactggggctggagcgccgatactgcggacggtaaaacctattcctgccagttagttggatatcagacgccgtataccgcctttaaagagggcgactacacgaaatgtgtacagcattatttcaacgttaatgtcgtcgatgataacggaaccactgaaccggatgtcacgccaactccggcgccagtgacggatgaaaacgtggcaccagtcgcgcgcattgccgggccggtcggggcggtggaagccggtagccaggtttcactcaacgcggaaggatcgaccgacgcgaatggcgacaagctcacctatacctggatgtcgcaggatggcaaaacgctgagcggccaggataaagccgttgtgattttcaacgcgccggatgtcactcagaacacccagtatgtggtgaatctgaccgttagcgacggtacgctctccagtacagcggtttatacgctgaatgtgaaagcgaaggccgccgctgcggatgacgaagataagaccaccagctaccctgcctggagcagcagccagaaatggaatccgggcgacatcgtcaacagtaatggcgcattgtaccagtgcaaaccgttcccggaaggctcatggtgtaatgttgcgcctgcctactatgagcccggcgtagggattgcctgggccgatgcatggaacgcattgtaataagataaatcctgtcggtgctttgcatcggcaggattgttactatgcttatctcaggttttttcaggagaaagcatgaacatcatcgccattatggggccgcacggggtttattataaagatgaacccatcaaggagcttgagcgtgcattacaatccctgggatttcaaattatctggccgcaaaatagcgttgacttgttgaagtttattgaacataacccgcgcatctgcggcgttatttttgactgggatgaatacagtctcgacctttgtagcgaaatcaaccagctaaatgaataccttcctctctacgcctttatcaataccaactccacgctggacgttagcgttcacgatatgcgcatggcgctgtggttttttgagtatgcattggggctggctgaagatatcgcgacgcgcattcatcaatatacaaacgaatatctcgataatattacgccgccgtttaccaaagcgctgtttacctacgccaaagaaggaaaatataccttttgtacgccggggcatatggcgggaacggtgtatcagaaaagcccgccaggctgtctgttttatgacttttttggcggcaataccttaaaggccgatgtgtcgatttcggtgactgaactgggatcgctgctggatcacaccgggccgcatctggaagcggaagagtatatcgcccgtacttttggcgccgagcagagttatatggtgacgaacggtacgtcgacctcgaataaaattgtcggtatgtatgccgcgcctgcgggaagtacgctacttattgatcgtaattgccataaatcgctggcgcatttgctgatgatgagcgatgtggtgcctctctggttgaagccgacgcgcaatgcgctcggcattctcggcggtattcctaagcgtgaatttacccgcgacagcattgcgcgtaaggtggcggaaaccgcgcaggcgcaatggccggtgcatgcggttatcaccaattcgacttacgatggtctgctgtataacactaactggatcaagcagatgctggacgttccctcgatccattttgattccgcctgggtaccctatacccatttccatccgatctaccaggggaaaagcgggatgagcggcgatcgggtgcccggaaaagtgattttcgaaacgcaatccacccataaaatgctggcggctttttcgcaggcgtcgcttattcatatcaaaggggaatatgacgaagagacgtttaacgaagcgtttatgatgcacacttctacatcgccgagctatcccattgtcgcctctatcgagaccgcggcggcgatgctgcgcggcaatccagggaaaagattgattaatcgttcggtggaacgggcgctccattttcgtaaagaagtacagcggttacgtgaagagtccgatagctggttctttgatatctggcagccggaagaggttgatgaggccgaatgctggccggtcacgccgggagaaacctggcatggcttcaccgatgctgatgacgatcatatgttcctcgatccggttaaggtgacaatcctgacgccggggatggatgaacagggcaacatgagcgaagaggggatacccgccgcgctggtggcgaagttcctcgatgagcgaggcgtggtggtggaaaaaaccgggccgtataatctgctgtttttgttcagcatagggattgataagacccgtgcgatggggctgctgcgcggactgacggaatttaaacgcgcctacgatcttaacctgcgcgtcaaaaatatgttgccggatctgtatgcggaagatccggatttttatcgcaatatgcgcattcaggatctggcgcaggggatccataaactgatccgccagcacgatcttccggagctgatgctgcgggcgttcgaggttttaccggagatgatcatgaccccgcaccaggcctggcagcgtcagatcaaaggtgaggtggaaaccgtggcgctcgatcaactgccagggcgcgtttccgcgaatatgatcctgccttatccgccaggcgttccgctgttgatgcccggcgagaggatcacgcaacagagtcgggccgtgctcgattttctgctgatgctctgttcgattggccagcattatcccggttttgaaacggatattcacggcgcgaaacggaatgaagacggggtgtaccaggtacgagtcttaaaacacgcctgttagcttgcctgacgagaatgtgacgagtaacgtactgataatcaataaaggagacgctatgctgggattaaaacaggttcatcacatcgcgatcattgcgacagactatgcggtgagcaaggcgttttattgcgatattctggggttcgatctgctaagcgaagcctggcgggaagagcgtgactcgtggaagggcgatttggcgctaaacgggcagtatgtgattgagcttttctcttttcccttccctccggcgcgtccaagccgacctgaagcctgcggtctgcgccatctggctttcagcgtggaaaatgtggaaaacgccgttgcgcatctggaaaagcatcaggttaagtgcgaaccgatacgcatcgatccgtataccgggaagcgctttacttttttcaacgatccggacggtttaccgcttgagctgtatgagcagtaaggcttgtcattaagacgctcgccaggtaacgttgccgggctaagtcactataagcatggatcatgaccactctcacgttgaatacctcgttactctcttctcgccgtattctggctgcctttagcggtggcctggattctacggtgcttctgcatcaactggtgttgtggcgagaacgccatcctgacgtcacgctgcgtgctatccatattcatcacggtttaagccctcatgctgatagctgggtgcggcattgcgaaaccgtatgcgaacgctggcaggttccgctggtagtggagcgggtgacgttggcggataatggcctgggtatcgaggcccatgcgcgtgaagcgcgctaccgggcgttcgcacagacgctattgcctggcgaagtgctggcaaccgcgcagcaccttgacgatcagtgtgaaacattcctgctggcgttaaagcgcggcagcggtccggccggactttccgcgatgggagaacgctcgccttttgccggaactctgcttcttcgcccgctgttgagagaaacgcggaagacgctggaacagtgggctgtgcgtcatggcttatgctggattgaagatgaaagcaatcaggatgacgcctacgatcgcaattttttacgcctgcgcgcgcttccgctcttacagcagcgctggccgcattttcctgcggcggtagcccgtagcgcgacgctctgcgccgagcaagaaaggctgctggacgagcttctggccagcgatcttacggactgtatcacgacggagggaacattgcggctctctccattaatgtcgatgagcgatgtgcggcgggcggcgattttgcgtcgctggctggcgatgcgtaatgcgccgatgccctctcgcgacgcgctggaacgtatctggcaggaggtggcgctggcgcgcgacgatgcctctccctgtttacgctttggcgatcacgagattcgccgttatcagtcgcaactgtggtggattaaaaccgtagccggacaacacgaaacgacggtcgcctggcccgtctggcaaacaccgctggcgctgcctgccggcttagggacggtacagctcgttcctggcggcgaactgcgccgaccgcgagaggaagaatccgtcagcattcggtttaaagcgccagggttgctacacattgtgggacgtcacggcggacgtaaattaaagaaaatctggcaggagcaggggatcccgccctggcgacgagacaccacgccgctgttgttttacggcgaaacgctgattgcggctgcgggtgtttttgtgacgcgtgagggagcagcagaagataaagaaggggtgagtctggtttggcatgcctgatggcgctgcgcttatcaggcctacgtatcgcatggaacgtaggccggataaggtgcttgcaccaccatccggcaacaaaatactcaggattcgctaactaccacggtaccaatttccgggtggctgaaactggcgattttatcgagacgaagttcacaagactcgccggaaacctcggcaagcagatactctacgtttttacgtaagatcaaatcgttcgcttttgcctgcaaaacctcgccatcttttaacgttagcgtcagtattaaatgatgcatgcaggcaagctcaagactatcgtagtcatcgcaattaatgggttgatacgtttcattcattgacataatcgctcaccagtaagttcgcggcagcataagctgccttttccctgaccgactctgaaagggcgctatctgccgccacttcattaagcactttcaatacacaacccagcgcatccgggacataccctaagtctccgctggcgatttccgcataccgcttgcgtactaactcacaatatttttccacatgccctcctgtcagcattctgacttaaccgtggatgcaagtctaagcctacgaagttaaatcttgtttagcaaggtgactataccatactcatttgcgcaatatcagcgcctgacgcgagtgggtaaaagattcgttaacagccttttagcgcggttttcgctacaatgggcgcctgattcgaaaggagttttctcatggcgcttaaagcgacaatttataaagccgtcgtcaatgtggctgaccttgatcgcaaccggtttctggatgcggcattgacgctggcgcgtcacccttctgaaacgcaggagcgcatgatgctgcgcctgttggcatggataaaatatgctgatgaacggttgcagtttacacgcgggctcagcgcggaagatgagccggaggcctggctgcgcaacgatcatctgggcatcgatctctggatagagctggggctgccggatgagcgccgtattaagaaagcctgtactcaggcgagcgacgtcgcgctctttgcttataactcccgggcggcgcaaatctggtggcagcagcatcaaagcaagtgcgcgcagttcgctaacctgtccgtctggtatctggatgacgggcagctggcgcagctcagtgaatttgccgatcgtaccatgacgctacaggcgacgattcaggacggcgcaatctggctttctgatgctcggaataatctggaaatacagctaaccgcctggcaacagccctcatgattgccatctcccggacggtctccatagccgataatgagctggaaattacggccattcgcgcgcagggcgcgggtggtcagcacgtaaataagacctctagcgcgattcatttgcgctttgacattcgggcctctggcctgccagagtattataaacagcgtttgctgacggccagccaccatctgataagcgatgatggcgtcattatcattaaggcgcaggagttccggagccaggagctcaaccgggaagcggctatcgccaggctggttgccgtcataaaagaattaaccgcggagcagaaaagccgtcgcgcaacccgtccgacgcgtgcctcgaaagagcgccgcttgtcctcaaaggcgcaaaaatcttctgtaaaggcgcttcgcggcaaaattcgtcgtccactggattgacgggcaggaatagcaatttcataaggattttatggtgagaacagcaatattgtcagtagcggcagcctgtacgctatttgcattgatagggtgtaataaccgtgcggaagttgacgccctgcaacctgcgcaggcggcggaattaaaacccatgcagcaaagctggcgcggcgtgctgccctgtgcggattgtgaaggtattgaaacgtcactgtttctggaaaaagacggcacatgggtgatgaacgagcgctatcagggcgtgcgcgaagaaccttcctcttttgcgtcatacggtacctgggcgcggacggcggataaactggtgttaaccgacagcaatggcgagaaatcgtattatcgcgcgaaaggcaatgcgctggagatgctcgacagagaaggcaatccggtggcttcgcagcttaattatacgctggtgcctgttaccgccagcctgccggtaacgccaatgccgctgcgtggtatgtatgtatacagggccgatgcggcgacctttaccgattgcgcgaccggaaaacggctgccggtcgccagtaacgcccagcttgagcgcggctatctggcggcgaaaggtgaagcggaaaaaccggtgctgctgacggtcgaagggcattttgtgtttgccgcgaatccggacacgggcgagccggtaaaaacgctaatagctgataaaaatgtgaagtttgcgccgggtaaagattgcactcactaataaatatcctccggcatagccggaggtttttctgatgcgcctgtaaggctctcttaccagccgcgccctaacaggcgcatacgatctgacatttgcatcaaacttcgttacttacggcccgtaaacaggctgcccggatacgggatcgataattgctcacccattttatcctcttcaagctggtgctttatgtagtcctgtatcttcgccgtattcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcgcaacattctgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaataaaaggcctcgcagggtgcgaggcctttacatatctgccggatggcgccgggcaatcccaacaaaatgtcgtttagcctttaatcgccttgaccagataatcaacgatatcgccggttttaatcagcgatttttcaccgctacgacggtatttatactcaatatcgtcgttatccaggttgcgatcgccaatcacgatagtatgtggaataccaatcagctccatatcggcaaacatcacgcccgggcgctctttacgatcgtccatcagcacttcaatgccctgcgcgcgcaattcgctgtacagcttttccgccagctcctgcacacggaaggatttgtgcatattcatcggcagaatagcgacctggaaaggtgcaatggcgtcaggccatacaatgccgcgctcgtcaaagttctgctcgatagccgcggcaacgacacgtgttacgccgataccatagcagcccattgtcaggatctggttacggccatcttcaccctgaacggaggctttcagcgcttctgagtacttggtacctaactggaagatgtgacccacttcgataccgcgtttgataagcaacgttccctgaccatccggactcggatcgccggcgactacgttacggatgtcggcaacaacaggcgtcgccacatcgcgatcccagttaataccaaagtagtgtttaccgtcgatgttagcgccagcggcaaaatcgctcatggcggcaacggtacgatcgatgatgaccggaatcggcatattgaccgggccgagggagccagggccggcattaattacggcgcgaatctcttcttcagtagcgaaggtcagcgggctggcaacgtgcggcagtttttccgctttaacttcattcagttcatgatcgccgcgaaccagcagagccaccagcggagacttgctgtctttcaccgctttcaccagcagcgtttttaccgttttttcaattggcaggttgaattgttccaccagctccgcgatggttttggcatttggcgtatcgaccagagtcatttcctgcgtcgccgctgcgcgcggtgtttgcggcgcgatagcttctgccagttcaatgttagccgcgtaatcagaaacatcagagaaaacgatatcgtcttcgccgctttgcgccagcacctggaattcatgcgaggcgttgccgccgatagaaccggtatcggcctgtaccgcgcggaaatccagccccatacggctgaagatacggctatacgcggcgtacatggcgtcataggtttcctgcaacgactcctgagaggtgtggaaagagtaagcatctttcatcaggaattcgcgcgaacgcatcacgccaaagcgcggacgcacttcatcacggaatttggtctggatttggaagaagttcagcggcaactgcttataagagctgagttcattacgcaccaggtcggtgataacttcttcgtgggtcgggccgagtacgaacggacgctcgccacggtcgacaaaacgcagcagttccggaccgtactgttcccaacgaccactctcttgccacaggtcggctggctgaacgactggcatcgacacctcgatagcaccggcgttgttcatctcttcacgcacgatgttttcgacttttttcaggacgcgcaggccggtcggcagccaggtatataacccggaggcgagcttgcggatcatcccggcgcgcagcatcagctggtggctgataacctcggcgtcggcaggtgtctctttcagagtggagagcaggtattggctagtacgcatgttgttacggttccagttgaacgatcgaacaggctcaatgtgagcctgatacaaaaaaagtgatttagtttaccagcgtgcaagagatgtcaaaagagaagggcgtgaaattaccgtggttccagcgcaaacacttcaaatccggtgttaaccacacgccagcgcacgttaaaatcatgcagccagacggcataggttttgcccgtctcttcacccttacgataagccgggcgaggatcttgcgccagcacatcgcaaataaatgtccgtagctgcggataacgcctttccagcgtcgtaagctgttgagccacttcagcggtaaaactcacaggcatttcagctatcggcgcctgttgcgcatagctggcggcggcgtccggtaaggcctcggcaaacggtaaatacggtttgatatccaccaccggcgtgccatccaccagatccagactgcctaatttcagaattacgctctctttccggcactcgataccttttagcgcaacgagcgacatgccaatcggattggggcggaacgtggagcgcgtggcaaaaacgcccattctggcgttaccgccaagacggggcggacgaactgttggccgccagccgccgtccatcgtctgatgaaaaacgaaaagcacccacaaatggctgaacgcttccaggccgcgaacggcatcggcctggttgtaaggcgctatcagatgcagttcgccgcaggcgcttttgaccagaccaggctggcgcggaacggcgaatttttctttatagggggagcgaataacgccgatttgatcaaactgaaagctgctcatttcgccgaaatattcagggcggacccgatacaaaccgcctgacggtagcagcctggcgtgccgctggtaatttcacagctgtgcagcaggacggcgttggctttcattttagatgcattaatctgcatacgcttgcgcgcagttggaatgttaggcggagagtcttgatttgtcgcctggcaggattcgccgctaacctcgccaagatcgcggaaaggtttgccgactaagtcttcagcattggtgtaaatcctgacgggagcggcacgcggcgctttaggtttctccggctccgcttttggcggggttgcggtgctttgaacaggttcaacaggggatctgcttagcatggaacaaccgcccagcatgagtgccaataaacagatcggtaaagcacgcataatatttcctcaatgaatgttctaattgccagatattgaatcaggagcttgcataaatgacaagacgggcaatagcccgtcctgaataatattacagattgtggaatcagcctaaaacttaccagcctttcaccgcgccgccattaaaaactttatttgcggcttcgtacacttcatcagactggtaagcctgaacgaattttttcacattctcggcgtctttgttatcttcacgcgtcacgatcaagttaacgtacggagaatctttatcttcaacgaagataccgtctttcgctggcgtcaggccaatctggctggcgtaagtcgtattgatgaccgctaacgcgatctgagcgtcatccagcgaacgcggcaactgcggcgcttccagctcaacaattttcagatttttcgggttttcgacgatatccagcgaggtaggaagcagactgacgccgtctttcagtttaatcagccctactttttgcagcagcagcagggaacgaccaaggttggtcgggtcgttaggcacagcgacctgggaaccgtccttgagctcatccagagatttgatttttttggaatatcctgcaatgggatagacaaaagtcttaccaacggaaaccagtttgtagccgcgatctttgatttgctgatccagatacggtttgtgctggaaggcattggcatcgatatcgcctttgctcagcgcttcattaggcagaacataatcattaaaggtcaccaattccacgtccaggccgtatttttctttcgcgactttctgcgcgacttcggcaacttgctgctctgcgccaacgattacgccgactttaatatgattcggatctttttcatcctgaccgcaacccgcaagtgccagagaaccaatcagagcacccactgccgcaaaggttttgaatttgaacgccatgcttatttccttaatgagtatttgtgttgtgtttaacgttacttatgcgtgacagccctgacgatgcgatcgccggataactgaattaaataaaccagaacgacaagtaataccagcaccgtattcatcacggtagcattgtatccaatataaccgtactgatagccgatttgaccgaggccgcctgcgccgacggcgccgcccattgcggagtaaccgaccagggtgattagtgtaatggttgccgcattcaccagaccaggcagcgcttccggtaaaaggattttacgtacaatttgcagcggcgtggcgcccatcgctcgcgaggcttcaatcagcccggcagggatctctaacaacgcattttccactatacgggcgataaaaggcgcggcgccgacggtcagcggtacaatcgcggcctgcaaaccaatggaggtgccgacaattattcgggtaaaaggaatcatccacaccaacaggatgataaagggaatcgagcggaaaatattgaccaccgcagagagggagcgatacagcctggcgttctccataatctgccccgggcgcgtaacatacagcaatacgccaaccggcaggccaatcacgaaaccgaagaaaccggagacaaaggtcatcgccagcgtttcccagacgccacgaaccagtaaccacatcattgcctcagacataacccagtacctctactttcacatggtgatcctgcagccaggcaattgcggcttgcgtctcttcttgtgtgccgtgcatttccgttagcataatgccgaacttcacaccgcccgcgtaatccatctgtgcgctgataatattattgttcacgttgaaacgacgcgcggtttcagaaagcagcggggcatccacagactgtccggtgaactccatgcgcagcatcggcacgctgtcagtttccggcgacgctttcaaacgcgcctggtaatcttccggaatgtccagatgcagagtggactgaataaacttctgcgccagcggcgttttaggatgcgagaagacttcgctgaccgtatcctgctcaataagctcgccattactgatgacggcaacgcagtcgcagatacgttttacgacatccatttcatgagtgataagcagaatcgtcaaccccagacgacggttgatatctttcagcaattccagaatcgaacgggtcgtcgcgggatcaagcgcgctggtggcttcatcgcacagcaacacttttggattactggctaacgcgcgggcaatcgcgacacgctgtttctgaccgccggaaagatttgccggatagctgtcgtgcttgtcgccaagaccgactaaatccagcagctctgtgacacggcgtttgatctcttcctttggtgtgttatccagttccagcggcaacgcgacgttgccaaacacggtacgggaagagagcaggttaaaatgttggaaaatcatgccgatttgacggcgagctttggtcaacccggactctgaaagcgttgtcagctcctgaccgcctaccattacgcttccttcagtaggacgttcaagtaagtttacgcagcgaatgagcgtacttttaccggcgccggaggcgccgatgacgccgtaaatttgtccggcagggacatgcaggctgacattgttcagcgcctgaatggtgcgcgccccctgctggaacactttggtaatattcgaaagtttaatcattgattctttattatcgtaatgaaatgagcggaggcattttcgtctgcctaatacggtcaacgccgtcaacagaatggatgttaaggcatccagacgtctaaatcaatcaggctttatacgatgagcactttcttgcctgctgaaacatgcgatactagcgccacttgctttactcaggagctataaaaggtggcaaagtctgtacccgcaatttttctcgaccgtgacggcaccattaatgtggatcacggctacgtacatgaaatcgatgcatttgagtttatagacggcgttattgacgcgatgcgcgagctaaaaaaaatgggctatgcgctggtggtggtgacgaaccagtccggaatcgcgcgcggcaaattcactgaggcgcagtttgaaacgttaaccgaatggatggactggtcgttggcggatcgcgatgttgatttggacggcatctattattgtcctcaccatccgcagggcagcatagaagagttccgtcaggtatgtgattgccgcaagccgcatccaggaatgcttatctcggcgcgtgatttcctgcatatcgatatggcggcttcttatatggtgggagacaagctggaagatatgcaggcggcagcggcggcaaatgtcgggacaaaagtgctggtgcgtacgggcaaaccggtcacggcagaagcagaaaacgcggcggactgggtgttaaacagccttgctgacctgccatcagcgataaaaaagcagcaaaaataagcgttatggataaaagatgagcggttaaaacaaaaatgcatttttccgcttgtcttcctgaaccgactccctataatgcgcctccatcgacacggcggatgtgaatcacttcacacaaacagccggtcggttgaagagaaaaatcctgaaattcagggttgactctgaaagaggaaagcgtaatatacgccacctcgcgacggtgagctgaaagccgcgtcgcacctgctctttaacaatttatcagacaatctgtgtgggcactcgaagatacggattcttgacgtcgcaagacgaaaaatgaataccaagtctcaggagtgaacacgtaattcattacgaagtttaattctttgagcatcaaacttttaaattgaagagtttgatcatggctcagattgaacgctggcggcaggcctaacacatgcaagtcgaacggtaacaggaagcagcttgctgctttgctgacgagtggcggacgggtgagtaatgtctgggaaactgcctgatggagggggataactactggaaacggtggctaataccgcataacgtcgcaagaccaaagagggggaccttcgggcctcttgccatcagatgtgcccagatgggattagcttgttggtgaggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtctacttggaggttgtgcccttgaggcgtggcttccggagctaacgcgttaagtagaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggggggcgcttaccactttgtgattcatgactggggtgaagtcgtaacaaggtaaccgtaggggaacctgcggttggatcacctccttaccttaaagaagcgtactttgcagtgctcacacagattgtctgatgaaaagtgaatagcaaggcgtcttgcgaagcagactgatacgtccccttcgtctagaggcccaggacaccgccctttcacggcggtaacaggggttcgaatcccctaggggacgccacttgcgcggtaatgtgtgaaaggcgttgccatcagtatctcaaaactgacttacgagtcacgtttgagatatttgctctttaaaaatctggatcaagctgaaaattgaaacacagaacaacgaaagttgttcgtgagtctctcaaattttcgcaacacgatgatgaatcgaaagaaacatcttcgggttgtgaggttaagcgactaagcgtacacggtggatgccctggcagtcagaggcgatgaagggcgtgctaatctgcgataagcgccggtaaggtgatatgaaccgttataaccggcgatacccgaatggggaaacccagtgtgattcgtcacactatcattaactgaatccataggttaatgaggcgaaccgggggaactgaaacatctaagtaccccgaggaaaagaaatcaaccgagattcccccagtagcggcgagcgaacggggaggagcccagagcctgaatcagcatgtgtgttagtggaagcgtctggaaaggcgcgcgatacagggtgacagccccgtacacaaaagcgcatatgctgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagccccaccactaagccagtggtgaactccacatacgcatcctttgctgaggagacggttaacggagcgaaagcgacgttcaacctcaaaagaagcagagggggcttagtggtggggtgactgcgtaccttttgtataatgggtcagcgacttatattctgtagcaaggttaactgtataggggagccggagggaaaccgagtcttaaccgggcgttaagttgcagggtatagacccgaaacccggtgatctagccatgggcaggttgaaggttgggtaacactaactggaggaccgaaccgactaatgttgaaaaattagcggatgacctgtggctgggggtgaaaggccaatcaaaccgggagatagctggttctccccgaaagctatttaggtagcgcctcgtgaattcatctccgggggtagagcactgtttcggctagggggccatcccggcttaccaacccgatgcaaactgcgaataccggagaatgttatcacgggagacacacggcgggtgctaatgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacaccgtgtgttgttgggtaggggagcgttctgtaagcctgtgaaggtgtgctgtgaggcatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacgggttaatattcccgtacttggtgttactgcgaaggggggacggagaaggctatgttggccgggcgacggttgtcccggtttaagcgtgtaggtatgtgttccaggtaaatccggttcactttaacactgaggcgtgacgacgaggcactacggtgctgaagcaacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgacacgtaggtgaagtgatttactcacggagctgaagtcagccgaagataccagctggctgcaactgtttattaaaaacacagcactgtgcaaacacgaaagtggacgtatacggtgtgacgcctgcccggtgccggaaggttaattgatggggtcagcgcaagcgaagctcctgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgtggacccgtgatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgagactttaggtctcctgaaggaacgttgaagacgacgacgttgataggccgggtgtgtaagcgcagcgatgcgttgagctaaccggtactaatgaaccgtgaggcttaaccttacaacgccgaagatgttttggcggatgagagacgattttcagcactgattccggattttcgggaacgaaagataaaagattcgtttccggcaacagaatttgcctggcggcactagcgcggtggtcccacctgaccccatgccgaactcagaagtgaaacgccgtagcgccgatggtagtgtggggtctccccatgcgagagtagggaactgccaggcatcaaattaagcaaaaggctcagtcgaaagactgggccttttgttttatctgtggtctgccggtgagcactctcctgaggaggacaaatccgccgggagcggatttgaacgttgcgcagtaacggcccgtagggtggcgggcagcacgcccgccataaactgccaggcatcagacaagtgaagaagcccgttctgacggacgggcttctttgcgtgtgtggtaactgtaaaaatgtaggcctgataagcgcagcgccatcaggcaacctgcaccgccggatggcagcttcgccttatccggcctacagcaattatcccgcctacgaagctggtgctcttgtagaaccgataagagcacaacccacccaatcgttaacgatgaactatcctttacacgtgcttatataagcagtgaggattttcattggctatcaaaccttttaactaccagcaagacttttccagcattgacttccgccagcagcctgaattgtatcaggttggacgaggagagcagggggggctactggttgaaccctacaaaagcgaaattcttcctttctggcgctataaagatgaagcatcggcgatgaaatccgcagaacagatctaccagttgttcgaagcttaccggcagcaggatgatttcgttggtatggacatggcgcgtaaatttattcagatgggatacacccgcgccaggcgatacgctaactataaaggtggtaaaaagtatgcagaagacggcagcctgaatacacggggtaatgatcctattaaggccgcggcggcaacggttttcaaaggttggtgggataaaatccgtcaggacgaagactatctgaaacggaaacgccagcatcaggcacggtggggataaaaattagcagacaaataattaacactttatttactttttagtctcgcgtaatctgaatctccaaaataaaaggccgattaagcctggcaacaaggagaacagtatggcagaaattattcagcgtatagataaaaacaacgctgaggctccggagatgcggcgacacatatgggctatcgtgggggcctcttccggaaacttagtggaatggtttgatttctacgtctactctttctgctcgctctattttgcacatatcttctttccttctagtaataccactactcagcttttgcaaacggcaggcgtctttgccgccggttttttaatgcggtctatcggtggttggctgtttggacgcattgccgatcgacgcgggcgcaaagcctcaatgttgatttcggtgtgcatgatgtgcatggggtcgctggtgattgcctgcttacctggttacgataccatcggcacctgggcaccggcgctgctacttattgcaaggttatttcaggggctctcggtagggggagagtatgggaccagcgcgacatatatgagtgaagttgcgcttgaaggtcgtaagggatttttcgcgtcgtttcagtacgttacgcttatcggtggccaactactggcattgctggtcgttgtgattttgcagcaggttctggaggatgctgagcttcgtgcctggggatggcgtattccctttgcgctgggcgccgtgctggcggttgtggcgttatggctacgtcgccagctggatgaaacctcgaagcatgagactcgcgcattaaaagaagccggttcgttgaaaggtttgtggcgtaatcgcaaagcctttttgatggtgcttggtttcaccgcggcaggctcgctgtgcttttataccttcaccacctatatgcagaaatatctggtaaatacagcaggtatgcatgccaatgtcgccagcggcattatgacggctgcgctgtgtgttttcatgttggtgcagccgttattcggcgcgttatccgataagattggcaggcgcacctctatgctatgttttggcgcactcgcgacgcttttcaccgttccaattctctccgcgttgcagaatgtgacgtcgccttatgccgcatttgctttagtgatgtgcgcgctattgattgtgagtttctatacctcgattagcgggatcctgaaagcggagatgtttccggcgcaggttcgcgccctgggcgtcggtttatcttacgcggtagcaaacgcgttatttggcggctctgcggaatatgtcgcgctgtcgctaaaatctgtcggtatggagagttcgttcttctggtatgttaccgcgatggccgttctggctttcctggtttcgttgatgttgcaccgtaaaggaaagggcttacgcctttagtatcgcgccatttgccagatagcgtaaccggttgtcgcgccagcgacatcccagacaaaatctttccagctccagccgctgccttccgggcggctgtcccagagttcttttgaggctccgagactcaaagaaaacatcagccctatcgctgcgctgcggtcagggcttactccctggtgacgcgcatactcattaccggctgccgatagcatcgctgatgccataaaatgctgggctttatcctgaccgctccagtggtcgttagccagatggctgcacccggagagaaacaacaccgtaaaaggaatcaacacgcgcaccagttcactcctaagagaaaaccccgtacaggacggggcttcgattacaggatacggctaattaatctgtcgatgcggatccggcgcagacggcgaatcaatttacgcacttttatcggatagtcggcaatgctctgcaggtcacgataatgttttacgatggttgtgtgcgttcggataagttccagctctttttcccgctgaggggcaagctcttgcttaggatcgtggatcagaatggcgttttccagatccagacgccaggcgcgaggattcagattgttgccggtgagtagcatccatttatcatctacccacatccctttcaaatgataggtattgtcgtcatctttccacagacgcaccacaagctgatcggtattgacgtaatactgtaaacggctcaggaagcggcgcaggttaatctcatagagatagggcagcgcgccaatgatcttgaacggttcatcttccggaatgtaaaaatcattcgcggttttatcgccaacaatgatttcgactttctttccgtcgcgcagtagctgaataatattccgcaccagtaccgctggtagattgaagtaaggggtacaaatggtgagcttatgctccgcacagggcatgagatggaaaatggttttgttcagcagactggattttccaagcccgaccagcggcgtaacggagagctgctcgtcattagcgtcaccctgaaaatgatatgacgcatcacgcagctcctgacggtataagcggatatcgtttttaatctccgggcttttcggccgctgggtattatccagacgattcacaccacggccattcatcagattttgcgtcacccagtcaaacatgatgtctgccatttgccgattgcgaatcagctggtagcgatcgtagcgatatttgtcatgctgatggagatagacatcgttcaggctggcgccgctgtacaggacgctatcatcaatgataaagcctttaaaatgcagtacgccaagcgcttctcgcgtattaatcggcacgccgtaaaccgggacatcaatgccggggttttcctgcgccagtcggcaataccagtctgcattggtattcgaggccgctgcgccaatgcgcccgcgttgcgcgcgatgccagtcgaccagcaccctcacgtccagttcaggacgctgccgtttagccgcatagagcgcgtcgagtatacctttacccccatcgtcctgttccagatacagggcaacgatacaaatacgctgcgtcgcgctggcgattttctccagcagtgtctcccgaaaagtagcaggagtataaaagaaatctacatcatcaactgactgagaaatcttagggagttgggcaaggtgttgttgatgtttattacgcttaaattttgacaacatcacagtgcatttcttctctgttcattgaagggtcctctgtgctatgcagacgacataagcgagcaataataacatcagtacccgttaaagtggtcaacatttccagtacattactcacgattcatcacatttggccagattcagcgtcaatcccacgatgccctcgtcgagctgaatatcgacctgaaatcccagttttctggccagcgcgaccatgccgcgattgttcggcatcgtaataccgttcagccgcttcaatccgtgatcgcgagtataggcaatcaatttctccattaaacggcgtcctaaacccaaccctttaagatctgaacgcaccaatacggcaaattcggcatctacgttgtcaggatcggagatcgcgcgcgttacgccgaggatctcttcagcgttgtccatccgcctcacggccacaaaggccatttctcgatcgtagtcgatctgcgtcatgttggctaaatcttcatgggtgaattcgttgatctcgctgaaataacggtagtaaagatcctctttggtgacctgtgcgatgaattgtcgcagttggggctcatcttccggcaggatcggacggaacaggcagcgatcgccgtttttcatctccacccactcttcaagctggtggggataggggcgtaccgcaagacgactttcgttatcgccatcaaacggggcaatatccagcgtcacatccagcgcggtaaactcactggcggaagccagcagcggatggatatccagacgctgaatttccgggcaatcgacaatcaggtttgaaacctggaccagcaattggcttaaaccgacaatatccagcggacgcagcgcgctacgggcgcgaattttccgctgtttaatgccctgaatcaccagatagcgcgccagattcatgttgagcggcggcagcgcgacgacggcctgctcttccggacgccactctacgccgccttcacccaacataatcaaaggaccaaacaccggatcgtgctcgaccaccacacgcagctcctgcgcgccggcgcggttagccatgctttgtaccagcaaaccgtgaatccgcgcctgcggccaggccatctttacacgatcgaaaatggcgttcgcggcctgttgtacctcgcttgcggtgcgcaggtaaagcatgaccccctgaacttcagatttatgcggaatgtcgggcgagcgcagcttgagagctaccggatagcctatctgttcggcgatatgcactgcttcagcgctgtcgctggcaatccaggttgggagcgtgtgcagcccataggcgtgtaaaatcggctgtacttcatgggtatccagtgaagtggcgccttccgcaatcgcccgctgtaacagattatgcgcctcagcggtattggacgtcaggttactcggcaacgctggcgtttcccgcagttgcttctggttacgccggtattccaccatgtgcataaacgcggtaatcgtgccttccggcgtgcggtaggttggtaatccggcttcgctgaacagccgtcttgcttcctgagatgagaactcgccgcaccagtttgtcagcagcgtaacaaacttgcctctggggtggcgcttaatcgtctcgatcagagcatgggcgctttccgtacccggcgcggcagcgctgggagagtggataaccataagcgcgtcaaaatcctgactggcgagcaggatatccagcgttttgacgtaatgttcgctgctggcgtcatcacacagatccagcggattggcaatatcaatgtgcgcgggaagcgtctgccgtagttgcaggcaggtctcttcgctcaatgtcgccagcttgccgttacgcgaccacaactcatctaacgccagcgcggcaggcgcggcgccattgctgatgatcatcagtctgtcgccgtgtagcggacgcatatggctaagtgtttcgacggcggaaaaaagctcgtgcgtatcctggactcgcagcaggcctgcgcgctggatggccgcatcccacgcagggtccattcccgcgctggtattaagtaaacgctgggctgccgggcttcggccgcttttaatcaccagaatcggtttgttacgtgaagcgctacgggcggcggaaacaaaacggcgggcgtcgcttaactgttccagatagagcaaaattgcgctggtcttgctatcgcgcgccagatagtccagtagttcatcgacatcaatatccaggctatcgcccagcgcgataaagtaggaaaagcccatttcacgctgttgcgcccagtcaagaatagtattggacacggcggcagactgggaaataaaagcgagcttgccctgtttaatcgggacgggagaaaagctggcattcagcccttgccacggcgcgaggagcccaagactgtttggacccagcagacgcattttataatgccgggcactggcaagaagttcttcatgttgcgacgtgggagcagaaaggataatgcacgttttacaacctttcgcgccaagcgcgtccagtaacgccaggttacggctggcgttagtgcataaaatagccagatcgggggtgaaaggaagactggcgatatccggccaggccatgacgcctaaaacggctttccaggcgggcgtcacgggaaggacggggccattgaatccgcccgccaacaagttacgcatcatcaggtaacccgcgcggtggggcttcattgatgcgccaatcaccgcgatcgattttggtcgcagtagcgcttccagtccttgctggctcataccggtttcccttacacagaagtgaccggataattttaaacgctttcgctattttatgctgtgacgtttcccggatgttgcgtttttcctgccagatagcgcgttttgaaacggatgaaatgttcacctaaactggttgccgcctcgggatctcccgccagatctaacaacgctatcgcgacttcggcggtacaatattgcccttcggcatggatttcacgcagacgataagctgaaagacgcgataaatcgacggaaatgaccggcagatgatccagataagggcttttacgaaacattttacgtgcttcgggccaggtgccgtccagcataataaacagcggcggtttcccggcgggcggggtggaaatgacctcgcgcgcttcgccggcgtaggacgcaggaaagaccactatcggctgataatccggatgctgtaccagctccagcaacgcctgcggcggctcggtacgcgaccactgaaacgccgcggtatctggcaaaatatcggctatcagccggccggtattgctgggtttcatcggttcagtgtcaaacatgaccagacaaaaacggcttttcgcctgagaaggcgttaacgtatcacacaggcaagattttagcggcagcaggcagcgttgacagcggcgaacccgattgcctctggcaagaaaagggcgagtagcgcgcgcaagccgttcggcgcgtaactgaaggacagcgttattggtcatagaaagcgtttgcggagaaaaacgctattgtggcagaggtgaaaacggggcacaagatgcgccccgtggcgtttacagcgcttcgttcagccagctgtcgaaaggcgctttaggcactgcgccattaagcatatcgaccacctgtccatgtttaaaaatcataatcatcgggatgctgcggataccgaaacgagcgctgagttcccgttccgcctcggtatttactttgacgaaacggactttaccgctgcgctcttctgcgacatcctcgaagattggcgcaaagttacggcaagggccgcaccagggtgcccaaaagtcgatcaccactggaagatcgtccttcaacagtttgtccagcgtttcgccggtcgcattaatgacttctccgtcaaacaactcatgaccgcagcgtccacattttgccgcgtcctgaagccgatcgccggggatgcggttaatggcctgacaatgggtacaaacggtgttcatagctaacctctgaatacgtcggaagacgtcccgctacgcgcgggatgtttctataatgttatatattatcgaggagtctgtgctaaacaacaatgtgttttattcaatgagtacaatagtcgcaagcttttaaacgaaatcatggctaaccggatgcacatcgggtaatcttcgcgcttcgcgcagcgctggtggagaaaagcatgaacgatgaattaaaaaacaaaagcggcaaagtcaaagtgatgtatgtccgtagtgatgatgactctgataaacgcacccataacccgcgtaccgggaaagggggaggccgcccagcaaagtctcgcactgacggtggacgtcgccccgcccgtgatgagcgaaataatcagagccgtgaccgtaaacatgaaacttcgccgtggcgcaccgtgtcccgcgcgccaggcgatgaaacgcctgagaaagtcgatcatggtggtattagcggtaaaagttttatcgaccctgaagttttgcgtcgccagcgtgcggaagagacgcgcgtctacggcgaaaatgcctgccaggcgctattccagagccgtcctgacgccatcgtgcgcgcatggtttatccaaagcgtaacgccgcgttttaaagaggcgctgcgctggatggcggcgaatcgtaaagcctaccatgtggtggatgaagccgaactggcaaaagcttccgggactgagcaccacggcggcgtgtgtttcctgattaaaaagcgtaacggtacgaccgttaagcaatgggtaaagcaggcggcggatcaagactgcgtgctggcgttggaagatgtcgctaacccgcataatctgggcggcatgatgcgtagctgcgcgcacttcggcgtgaagggcgtggtggtacaggatgcagcgttgctggagtccggcgcggcgattcgtaccgcggaaggcggggcggaacatgtccagccaatcactggtgaaagcattgttgacgtactggatgactttcgtcaggcggggtacaccgtggtgacgacgtccagcgatcgcggtcaggcgctctttagtacgaccctgccggaaaagatggtgctggtcttaggccgtgaatatgactacctgccggaagcggcgcgcgaacccgacgatctgtgcgtgaaaattaacggcaccgggaacgtggaaagcctgaatgtgtcggttgcgacaggcgtactgctcgccgagtggtggcgacagaataaagcgtaagggctgcagcccggtgacgcaacgcgcgccgggccaatgatgtactttctaccgcccggtcagacaaggcgctttcgcgccgttatccgggcgataaaacggcgagtcgccaacgttattcactctcagccggtaatactggcgtccagtcgatagttttctcgccgtgttgttccagccattggttcgttagcgcaaaatggttacagccaaaaaatccgcggtgcgcagagagtggcgagggatgcggagctttcagaatatggtggcgctgtggatcaataatcgcgcctttcttctgggcgtgcgagccccacagcaggaagacgaccccttcgcggtgttggttaatcaggcttatcactttatccgtaaaggtttcccaccccaggctggcatgagagtgcgcctggcctgcccgtaccgtgagcaccgtattcagtaacagtacgccctggcgcgcccagctttccagataaccgtgcgcggggcgaacaaagccgggaatggaggcttccagctctttgtacatattcactaatgacggcgggggagcgatcccaggacgcacggaaaacgccagaccatgtgcctggccggggccgtggtaaggatcttgtcccaggatcaccaccttaacgtcgcccagttccgtgaagcgaaaggcgttaaatacatctttttgcggcgggtagaccgtgatacccgactgacgctcgccagcaacagtgtgaagcgtattgataaagtaaggttgctgtttctcatcagccagcacatcgtgccaggttaactcagtcgccatctcgctctcctgcgaatttccagttcccttagcttaactgcttctttctgcagtgcaaaatcctgcgtgctacaaaaacggttacctacaaaagatagttgaaaatttatgtaaaaagtttataggtctgaatggtgtaagttgatgtaaaacaataaattcccttcatcaccctttttatggtgtggtttttattgatttaaatcaaagaatgaagggtgatcgaagggtatatatacactcaagcaacaatggttttaccaattggccgggattaggccgaccgaaatcaaataattttgcctggggaggcatcacatgattacaggtatccagattactaaagccgctaacgacgacctgctgaattccttctggctgctggacagcgaaaaaggcgaagcgcgctgcatcgttgcaaaatccggctttgctgaagatgaagttgtggctgtcagcaaactgggcgagattgaataccgtgaaattccgatggaagttaaaccggaagtacgcgttgaaggcggtcagcatctgaacgttaacgttctgcgtcgtgaaactctggaagacgcggttaagcatccggaaaaatacccgcagctgactattcgtgtttctggttatgcggtgcgttttaactccctgacgccggaacagcagcgcgacgttatcgctcgtacctttaccgaaagcctgtaaggcttatccggtaataacaagcggaagaggccgggccttttccgcttttgttttatttgtgtcagtaaaaaatccgcaccgcgcagtacaccagcagtaacgccagaatgatatttaactggcgaccataatggcgaaacgcccgctgaaacagatgtcccgccagcgcccagcacacattaccgaacgtgccgatcaatgccagcaatatactgacgccgatgacccagttcagcgcctgcgtttgcggtaaaacaaatgtagacagagcggtaatgccgtacagaataattttgacgttcacaaactgcaggccaaagcttacccaaaagccaaccggttttggtctgaccttctcatccgccgctggactggtggcaattttccacgccagccacaggatatacgcagcccctacccaactgagcaaatgaatgattgccggatcgataaccgcaagggaaaacgcgatcccggcgcacagcagcatgacgaccaaaaatcccagactcatacctgccagtacacgaatactctgccgaaaaccatgtgcagttgctgcgctaagcgcgagaatattgtttgggccgggggtaagggcggtgattaatgtataagtccagaaagcgcttaaaagcatcggtgtcacttgtcatctcctctgttttagcagacagtacccgatatgaaatatttaaaaaaatgaatgttttttaattctgaattcgagattttcgataggttggtggttatggatctgcgtcggtttattacgctgaaaacggtagtggaagagggctcgtttctgcgggcttcgcaaaagctgtgctgtactcagtcgacggtaacttttcatattcaacagcttgaacgtgagttttccctgcaactgttcgagaaaatagggcgccgaatgtgcctgaccaatgaggggaaaaagctgataccgcatatccatgaactgacgcgtgtgatggagtcgattcgtgaagccgcaagacaggatgcggaacccggcggagagctgcgcgtggcgacaggtgaaaccttactggcatacaaaatgccgcaggttttacaacgttttaagctgcgagcgccgaatgtcagattgtcgctacagtcgctgaattgctatgtgatacgtgatgcgttgctgaatgacgaggtcgatctgggcgttttttatcgcgtaggtaatgatgacgcgctcacgatgcagcaactgggggagcagccgctggcgctggtggcctctccactgctacaggatgctgattttacgcagccagatcagcatatccctgcagcttcatcatcaatgaaccgcaatgtgtcttccgccagctatttgaaagtacgctacggcagaggcggattacgctggaaaacaccattgaactgtggagtattgaaagcattaaacagtgtgtggctgctaacctgggcatcagctttttaccgcgatttgccgttgaacgagaacttagcaccggtcagttgaaagagctgccgtttggcgcgccgtcgctatcgatcatggcgctgtgcgcccatcatgccgggaaagcggtcagcccggcaatgcagatatttatgcagtgtatggaggcgtgttttaccgtggaagataaaaaatgccgggttaacgaacccggcattatcatcactcttcgctggattgctcctgcattttcgtaccgcttggcttgcggcgcttaccgatattttttgtatcgcggtaacgtttcttcacgcgcggcttctctttttctttctcttttttcttctcggcgcgtttcgccagcacttttttcgacggtttgccggtcagcttttcgctgggcgcacgcgtggtcgggcgaagctcatcaatgacgcgcgcttttagcggctcttcgatgtagcgaccgattttcagcagcaacagatggtcgtgggcttcaaccagcgagattgcagtgcctttgcgacccgcacggcctgtacgaccaatgcgatgcagataggtatcgccactgcgcggcatgtcgaagttaatgacgtggctgacgtcaggaatatcaatcccgcgtgccgcgacgtcggtcgcgaccagcacgttaacgcgaccgtcggtgagacgcttaataccctcgttacgtttgatctgcgccatctcgccttcaagatagcaattgttgatccctgccagacgcagcgtttcagccagttcatggacgcgttcacgtttacgtacaaacacgatagaacgggttgcatcgtcttgttttagcaggtgcttcaacagcgcaactttatgttcgaaattgtcggcacggtagtaccactggtgaattttcttgcgctcgcgggttgacggattggcggaaacctcaaccgggtcttccagcaggcgctcggcaaaatctttaatcgcatcgccttccagcgtggcggagaacagcatcgtctgtttacgccagcgggtctcaccagcgatatgttcaatgtcctgagcgaagcccatgtcgagcatccggtcagcttcgtcaaggatcagtgtttcaaccgcccggcagtcaaaattctcttcttttatatattgcagcagacggcccgtcgtggcgaccacgatatcctggttttcgctaaacacttcagcatggttcatataggccacgccgccggtaatcgtggcgatatccagatgagtatgcttagccagttcacgagcgtgatcggcaacctgcattgccagttcgcgggttggcgtcaggatcagaatgcgcggcggccccgattttttacgcggaaagtcgagcaggtgctgcaacgccggcagcagatatgccgccgtttttccggtgcctgtcggcgcagaaccgagtacatcacggccatcgagcgcaggcggaatggcggcagcctgaatggcggtcgggcgagtgaaacctttatcctggagggcatccagcaggctttcgtcgagttcaagttcggaaaaagtcgttacagtcatgttctacctctgtgtggggcgctgattatagacgttacggccgcaatcttcatctgtttgtatggatatcccttctcaggtattgttttcactcggcgctgtcgccgttttttgcaaggttgtttttacatgtctcagtctggctccgttcttcgtcgtaacggatttacgtttaaacagttttttgtcgcacacgatcggtgtgcgatgaaagtgggaactgacggtattttactcggggcgtgggcgccggtcgcggatgtaaagcgaattctggatatcggtactggaagcggtctgctggcgttaatgctggcgcagcggacggatgacagtgtgcctgttgacgccgtggaactggatgccggggctgccatgcaagcgcaggaaaacgtggctcactctccatggccgcatcgaataacggtgcatactgacgatattcagcgttgggcgcctcgccagacggtacgctttgatcttattatcagcaacccgccttattacgaacccggtgtggaatgctccacgccgcagcgggagcaggcgcgttacaccgctacgctggatcaccagacgttattggctattgcggcggattgtattaccgaagatggctttttttgcgtagtcttgccggaacaaataggtaacgcttttacgcagcaagcgctcaacatgggatggcatttgcggttacgtactgacgttgcggaaaacgaagcgcgcttgccgcaccgggttttgctcgcattctccccgcaagccggggagtgctttagcgacagattagtaattcgcgggtcagaccagaattattctgaaagttatacggcgctgacccaggcattttatctgtttatgtgaggcgttaacggcgaaaggatcgatgggcctgattcagccagttgttgcggataatccagcgtaaagtgcagcccccggctctctttacgcatcatcgcgcaacgcacaatcagttcggccacttgcaccagattgcgcagctccagtaaattattcgagacgcgaaagttggcgtaatattcgtcaatctcttgttgcaacatagtaatacgccgtagggcgcgctccagccgtttcgtcgtgcgcacaatccccacatagtcccacatcagcagacgcagttcgtgccagttatgctgaatcaccacccgctcatcggcgttctccacgcggctttcatcccaggcgggaaggacgtcaacgctgtggacagaaggcattcgcctgtcgatatccattgccgcggaccagccgtacactaagcattccagtaacgagttggacgccatacggttagcgccgtgcagaccggtgtaactgacttcgccaatggcatataagccgtctacatcggtacgaccataatcatcgacgaccacgccgccgcaggtatagtgcgcggcaggaacaatgggaatcggttctttggttaaatccatccccaaatcgagcagtttcgcatagatcatcgggaagtgctggcggacaaaatcgtcaggcttgtggctgatatcgagaaacatacagtctgcgccgagtcgtttcatctcatgatcaatagcgcgggcgacaatatcgcgcggcgccagttcgccgcgttcgtcaacgtccggcataaaccgtgaaccgtccggacgtttaaggtatgcgccttcgccgcgcagcgcttcggtaaggagaaaattacgcgcctgcgggtgataaagggcagtgggatgaaactggttaaattccagattagcgacccgacagcccgcgcgccaggccatcgcgataccgtcaccggaggaaatatccgggttagtggtatattgatacacctttgaggcgccgccggtcgccagcaccaccgacttcgcatgacaggtttcaacccactctttattgcgattccagatccaggcgccgacgacccggcgaggccccggcagacctattttatcggagataattaaatcaacggcgttgctgcgttccagcacctgaatattaggatgattttgtgcccgactgaccaacgtggtttcgacttcctttccggtagcgtcggcggcatgaaggatacggcgatggctatggccgccttcacgcgtgagatgatagctctccttgccgtttggctggacatgcgtatcaaacaggacgccctgatcgataagccactgcacgcaggtacgagcgttgctggcgacaaactccaccgcgtggcgatcgcaaattccggcgccggcaatcagcgtatcttcgacatgcgatgcaatgctgtcggtttcatcaaacacggcggcaataccgccctgtgcataaaacgtggagccctcgctcaccggccctttactcaggacgataaccttatgcttttcagccagacgcagcgccagcgagagtccggccgcgccgctgccgataattaacacatcacaggacagttcaggagttgtcatcatggttcttgtttaatttactaaacatggttgcggcagattagcactatatggcgctaaaaagcacgttatgatttcaaaagtgttgtgcttattaaacataaaataaaaatacggcgagagataaacggcaaaaaatattttatagggcagggtgttagcgtcggattttgtagtgaaataaagatgctgttaggttactctgcaaacgacgaaatgggcatttctgtacagatagtgcgttgttcagcatctgtagacttataatggaagataagacctgtctacaacatgacaaacaaaaacaaatgcgtaacggaactttacgaaacatagacactctaacctgttgcttgctcatagtgcggcttatggagtggcgtttcgaaagcgcgtggaaatttggtttggggagacattacctcggatgagcgagcagttaacggaccaggtcctggttgaacgggtccagaagggagatcagaaagcctttaacttactggtagtgcgctaccagcataaagtggcgagtctggtttcccgctatgtgccatcgggcgacgttcccgatgtcgtacaggaatcatttattaaggcctatcgcgcgctggattctttccggggggatagcgctttttatacctggttgtatcgtattgcggtcaataccgcgaagaactacctggttgcgcaggggcgtcgtccgccttccagtgatgtagacgcgattgaagcagaaaactttgaaagcggcggcgcgctgaaagaaatttcgaaccctgagaacttaatgttgtcagaagaactgagacagatagttttccgaactattgagtccctcccggaagatttacgtatggcaatcaccttacgggagctggatggcctgagctatgaagagatagcggctatcatggattgcccggtggggacggtgcgttcacgtatcttccgggcgcgggaagctattgataataaagttcaaccgcttatcaggcgttgacgatagcgggatactggaaaaggtattaggcatgcagaaagaaaaactttccgctttgatggatggcgaaacgttggatagtgagctgctcaaagcgcttacgcacgactcggaaatgcagaaaacctgggagagttatcacctgatccgcgattcaatgcggggggatacgcctgacgttctccatttcgatatatccgcccgcgtgatggccgctattgaaaacgagccagtacgtcaggtgacgccattaatccctgaggcccaacccgctccgcagcaatggcagaaaatgccgttctggaaaaaagtgcgtccgtgggcggcgcagcttacccaaatgggcgtggcggcgtgcgtttcacttgcagttatcgtcggtgtccagcactataatgggcaatctgaaacatcccaacaacctgaaacgccggttttcaataccctgcctatgatggggaaagccagcccggtaagtctgggagtgccttctgaagcagcgcctgtcggcagtcagcaacagcaggtacaggagcagcgtcgtcgcattaatgccatgttgcaggactatgaactgcagcgccgactgcactccgaacagcttcagtttgagcaggcgcaaacccagcaagccgcggtacaggtgccaggaatccaaactttaggaacgcaatcgcagtaatgaagcaactttggtttgccatgtcccttgtggcggctagcctgttcttctcagtaaacgcctcggccgaccctgcgtccggggcgttattgcagcagatgaacatcgccagtcagtcactgaattacgagctgtcattcgtcagcatcacgaaacaaggcgttgaatctctgcgttatcgacacgcacgcctggatagtcgcccgcttgcgcaattgctacagttggacggtccccgccgggaggtcgtacagcgtggtaatgaaatcagttattttgaaccgggccttgagccgttcaccctgaacggtgattatattgtcgattctctgccttccctgatttacaccgatttcaagcgtctggcgccttactacgactttatttccgtcggacgcacccgtatcgcagacagattatgcgaagttatccgcgttgtggcgcgcgatggtacgcgttacagctatatcgtctggatggacatggacaccaaactaccgatgcgcgttgatctgctggatcgcgacggcgagacgctggagcagttccgcgttattgcgttcacggtgagtcaggatatcggcagcaccatgcaggcgctggcgaaggcgaatctgccgccgctgctttctgttcccggtggcgaaaaaacgaaatttaactggaatccatcctgggtgccgcaaggctttagcgaagtttccagcagccgtcgtccgttgccgacgatggataacctgcctatcgaatcgcggctttattctgacggtctgtttagcttttccgtcaatgtgaaccgggcgacgcaaaacagcagcgatcagatgctgcgcaccgggcgccgaacggtttatagcagcgttcgcgacaacgcggaaatcaccattgtcggagagcttccgccgcaaacggcgaagcgcattgccgacagtatcaaattcagggcagtacaatgattaaagagtgggcaaccgttatctcctggcagaatggtcaggcggtggtgagctgcgacgttaaagcgtcatgcagcagctgcgcctcccgtgcgggatgcggcagtcgcgtgctgaataaattagggccgcaaaccacgcataccattgttgtgccaagcgcggagccgctggctccggggcagaaagtcgagttgggcatcgccgaaaaaagccttttaggttcggcgttgctggtctatatgtcgcctttagcggggctatttctttgtgcggcgctttttcagatgctgtttggatctgaccttgccgcattaagcggggccgtgctgggcggagtgggcggttttctggttgcccgcggctattcccgaaaactggcggagcgcgacgcctggcagcccgtgattttaaacgttgccctcccgcctgaccttgtccgcgtcgaaactacctcaatcgaaacgcgccagtaaacgttttgcccaatggtacatggtacacctgccgcgttgggttgttgtcccgataagcatgcgcttttcctgcgttgcggtgttttacaggaaaaaagcgaggcgttttccagttcccgctctccttacactatgaacatttcctcgccttagcgttgtagtgtagaatgcggcgtttcagttaaaacagacgttaagctcagaacagcgacctctaaagtctggtcaaccaggcgtaaggcataataatttatctctatgaagaacatacgtaacttttcgatcattgctcacattgaccacggtaaatcgacgctgtctgaccgtattatccaaatctgcggtggcctgtctgaccgtgaaatggaagctcaggtacttgattcgatggatcttgagcgtgagcgcggtattactattaaagcccagagtgtgacgctggattttaaagcgtctgatggtgaaacttatcaactgaactttatcgacacgccgggacacgttgacttttcctatgaagtttcccgttcgttagccgcctgcgagggcgcgctgctggtggtggatgccggccagggcgtagaagcgcaaacgttggcgaactgctacaccgcgatggaaatggatcttgaagtggtgccggtgcttaacaagattgacctgccggccgccgatccggagcgtgtggcggaagaaatcgaagacattgtcggcatcgatgcgacggacgcggtacgctgctccgccaaaacgggtgtcggcgtgacggacgttctggaacgcctggtgcgcgatatcccgccgccgcaaggcgatccggacggcccgctgcaggcgctgattattgactcctggttcgataactacctgggcgtggtatccctggtgcgtattaaaaacggcaccatgcgtaaaggcgacaaaattaaagtgatgagcaccgggcagacctacaacgctgaccgcctggggatcttcacgccgaaacaggttgatcgtaccgagctgaagtgcggcgaagtaggctggctggtctgcgccattaaagatatcctcggcgcgccggttggcgataccttaacctcagcgcgtaacccagctgaaaaagcgttgccgggctttaagaaggtgaaaccgcaggtctatgcaggtctgttcccggtcagctccgacgattatgaaagtttccgcgacgcgctcggcaagctgagcctgaacgatgcctcactgttttatgaaccggaaagctcctcggcgctgggctttggtttccgctgcggcttcctcggcctgttgcacatggagatcattcaggagcgtctggaacgcgaatacgatctggatctgatcaccactgcgccgaccgtggtttatgaagtagaaacaacggcgaaagagactatctatgttgatagcccctccaagctgccgccgttgaataacatttatgaactgcgcgagcctatcgccgaatgtcatatgctgttaccacaagcctatttaggtaacgttattacgctgtgtattgagaaacgcggcgtacaaactaacatggtgtatcacggtaaccaggttgcgttgacctatgaaatcccgatggcggaagtggtgctcgacttctttgaccgtctgaaatcaacgtcgcgcggctatgcgtctctggattataacttcaagcgcttccaggcttccgatatggtgcgtgttgatgtgttaatcaacaacgagcgtgtcgatgcgctggcgctgatcacgcaccgtgataactcgcaaagccgtggtcgcgagctggtggagaaaatgaaagatttgattccacgccagcagtttgatatcgcgattcaggcggcgattggtacgcatattattgcccgttcgacggtaaaacagttacgtaaaaacgtgctggcgaagtgctacggcggcgatatcagtcgtaagaaaaaactgctgcagaaacagaaagaaggtaagaaacgcatgaagcagatcggtaacgtcgagctgcctcaggaggcgttcctcgccattctgcatgtcggtaaagacaataaataatccctaaggagttggcatggcgaacatgtttgccctgattctggtgatagccacactggtgacgggcattttatggtgcgttgataagtttgttttcgcgccaaaacgtcgggcgcgccaggctgccgcgcaaacggcgtcgggagatgcgctggataacgctacgctcaataaagtggcgcctaagccgggctggctggagaccggggcgtcggttttcccggttctggcgatcgttctgatcgttcgttcatttctttatgaaccctttcagatcccgtcaggctcaatgatgccgacactgcttatcggcgattttattctggtggaaaaatttgcctacggcattaaagatccgatctaccagaaaaccctgattgaaaccggtcatccaaagcgcggggatattgtggtatttaaatatccggaagatcctaagttagattacatcaaacgcgccgtcggtttgccgggcgataaaatcacttatgatccggttgcgaaagaggtgacgattcagcctggctgtagctccggtcaggcgtgcgaaaatgcgctgccggttacctactctaacgttgagccgagcgattttgtacagacctttgcccgccgtaacggcggagaagcgaccagcggtttctttgaggttccgctaaacgagacaaaagaaaacggcattcgcctgaccgaacgtaaagagacgttaggcgatgtgacccaccgcatcctgatggtgccgatagcccaggatcagttgggcatgtattaccaacagccaggacaaccgctggcgacctgggttgtaccgccggggcaatatttcatgatgggcgacaaccgcgataacagcgcggatagtcgttactggggatttgttccggaagcgaatctggtcggtaaagcggtcgctatctggatgagctttgacaagcaggaaggggagtggccgacaggcgtacgcctgagtcgtatcggcggtattcactaactgtggcgaaatgatcgttcacgctgtcgtctttttagcggcagcgtgaattatttcctggataaattccctcagactaacgacatcccctgtcgttgtgtatagaatattcccccgaagttttaggttggcgccgtttggtcgccacggcacacgaaacagcgttggttatagacaaccttctttccgctgcagcgatgcggcaggacagatgacgtgtatcaggtctgtttcgtgtgctggattgttgacgcattcatttattggtatcgcatgaaccccatcgtaattaatcggcttcaacggaagctgggctacacttttaatcatcaggagctgttgcagcaggcattaactcaccgcagcgccagcagtaaacataacgaacgcctggagtttttaggcgattcaatcctgagcttcgttatcgctaacgcgctttatcaccgttttccacgggtggatgagggagatatgagccgtatgcgcgccacgttggtacgtggtaatacgctggcggaattagcccgtgaatttgatttaggcgagtgcctgcgtttagggccgggcgaattaaaaagcggcggatttcgtcgggagtccattctggcggacaccgtggaagcgttaatcggcggagtatttctcgatagcaatatccagaccgtcgagcagttaatccttaactggtataaaacccgtctggatgagataagtccgggcgataaacaaaaagatcctaaaacgcgcttgcaggagtatttgcagggtcgccatctgccgctgccatcttacctggttgtgcaggtacgcggcgaggcgcacgatcaggaatttactatccactgccaggtcagcggcctgagcgaaccggtggttggcacgggttccagccgtcgtaaggcggagcaggctgccgccgaacaggcgctgaaaaaactggagttggaatgagcaccgacaaaacttactgcggatttattgccatcgtcggacgtccgaacgttggcaaatccaccttgctgaacaaactgctcgggcagaagatttcgatcacttcccgtaaagcgcagaccacgcgccaccgcattgtcggtattcataccgaaggcccgtatcaggcaatctatgtcgataccccgggactgcatatggaagaaaagcgcgccattaaccgtttgatgaataaggcggcgagcagttcgattggcgacgttgagctggtgattttcgttgtagaaggcacccgttggacgccggacgacgaaatggtcctgaacaaactgcgcgatggcaaagcgccggttattctcgccgttaacaaggtggataacgtgcaggaaaaagccgatttgctgccgcacctccagttcctggcaagccagatgaactttcttgatatcgtccccatctctgctgaaacgggtatgaacgtcgataccattgccagtatcgtgcgtaaacatttaccggaagcgattcaccacttcccggaagattatatcaccgatcgctctcagcgctttatggcgtctgaaatcattcgtgaaaagctgatgcgttttctcggcgccgagctgccgtattccgttaccgttgagattgaacgttttgttaccaacgaacgcggcggctatgatatcaacgggctgatcctcgtcgagcgcgaagggcagaagaagatggtgattggcaacaaaggcgccaaaatcaaaaccattggtattgaagcgcgtaaagacatgcaggagatgtttgaagcgccggtacacctggaactgtgggtgaaagtgaaatccggctgggccgatgacgaacgcgctctgcgcagtctcggttacgtagacgatctgtgagttaacacagcgtggaagggtggcagcgcgcatttgtcctgcacagtcgcccctggagcgaaaccagcctgatgctggacgtcttcacggaagaatcggggcgcgtgcgccttgtcgccaaaggcgcgcgatctaaacgttccaatctgaaaggcgcgttgcagccttttacgccgttattgctacgctacagcggacgcggcgaggtgaaaaccctgcgcagcgccgaggcagtttctctggcgctgccgttaagcggtattacgctctatagcggcctgtatatcaacgaactcctctctcgcgtactggaatatgaaacgcgcttctccgaactcttttttgattatctgaactgtattcaggcgctggcgggaaccaccggctcgcctgaaccggcgttgcgacgtttcgaactggcgttgctgggacatctggggtatggcgtcaatttcacccactgtgcaggcagcggcgaacgggtggatgacaccatgacctaccgttaccgcgaagaaaaaggctttttcgccagcgtcgtcatcgataacaacacctttaccggacggcacctgaaagcgctggaggcgcgggaatttccggatgtagataccctgcgtgccgctaaacgctttacccgtatggcattaaagccgtatcttgggggaaaaccgttaaaaagccgggagctgttccggcaatttatgcccaaacgcacagtaaaaacgaagaaagattaacgaggattgtcatggctgaattactgttaggcgtcaatattgaccacattgccacgttacgtaatgcgcgcggcaccgactatccggatccggtacaggcggcgtttattgctgaacaggcaggcgcggacggcattaccgtacacctgcgcgaagatcgtcgccacattaccgatcgcgatgtgcgcattctgcgtcagacgctgcatacgcgtatgaatctggagatggcggtgaccgaagagatgctggcgatcgccgtagaaaccaggccgcatttctgttgtctggtgccggaaaaacgccaggaagtcaccaccgaaggcggcctggatgtggccggacagcgcgataaaatgcgtgatgcctgtgcgcgcctagcggcggctggcatccaggtttcgctctttatcgatgccgatgaaaggcaaatcaacgcggcggcggaagtcggcgcgccgtttatcgaaatccataccggctgctatgccaacgcagaaaccgatgcggaacaggcaaaagagctggcgcgtattgccagcgccgcgaccctggcggcccgtctggggctaaaagtaaatgcgggtcatggcctgacctaccataacgtcaaagctattgccgcactgccggaaatgcacgagctcaatatcggtcatgccattattggtcgggcggtgatgacggggctgaaagaggcggtggctgaaatgaaacgtttgatgctggaagcgcgcggctaatggcgattctcggcctgggaacggatattgtagagattgcccgcattgaggcagtgatctcccgttccggcgaacgtctggcaaggcgtgtgctcagtgacaacgagtgggctatctgggagacgcatcagcagccggtgcgttttctcgccaagcgttttgcggtcaaagaggcggcagcgaaagcttttggcaccggcatccgcaacggtctggcgtttaatcagttcgaagtgtttaacgatgagctgggaaaaccacgtttgcggctgtggggcgaggcgttaacgctggcggaaaaactcggtgtggcgcacatgcatgtcacgttggccgatgaacgccattacgcctgcgctacggtcattctggaaagttagatttgccggatggcggcgtaaacacgttatctgacctacaggccgatatattgccggcctgataagcacagcgccatcaggcattgttgcgttggaagtgcgttaacccgcttacaatttatctgcgtgatgcatcagaacaaacttatcccacaactgttcttcggtttcgacatgggcgggatcctgcaaaatcgtattggggatcgggcagactttctgacaggtcggcgtttcgtaatggcctacacactcggtgcatttgtcgctgttaatctcataaatgctgtcgcccattgaaatcgcctcattcgggcactccggctcgcacatatcgcaattgatacattttttggtgattaacagcgccatcaggaaattctcagaaacaacacaaatcgggcgggcattatacgcctattttctactcgggccagctcttttctggcgctgatttgttatctacagtgtaaaaatttttgatctgcttgagcaggcagatggttgcgttatccagtgaaaggtcattactgtgcaccagcatgacaggaataaagaatgcggggatgcccagtgaaaccaggcgaacatttttgggtgtcgataaatgggttagcgagcgggtaataaatgcgatgccaatctgcgcttcggcatactcaaggcatgagtagtggttatccagttcgcagatgacgttaggaacgactttgcggttattaaattctgtggtgatgatccctcttaatagcagagagtcattaagcacgataatgggctggtcgtttaaatcttttagatgcagacgttcgcgtgtcgccagaggatgagaaagtgggattgcagcgataatttcatcttcaaacagcatggtcgagcttagctgggcagggagcgctgttcgataaacaatgccaatatcaacggcgctatccgtcagctttttaatggtttgctcagttgagaactctttaacatttaaagatatttccggatggtgcgccataaagttgcgaaaagcgggcaggaccaggtagctgcctgacaccccgattgaaatagtatcgcgctgttgatcctgatagggaagaagttcattttcggcattttttaaatccagcattattttgttagcgtgtcgttgcaaaataatgcctgcttttgttaatttaattcctctgccttttcgcttaaataatattgttttaagtgatgactcaagttgtttgatttgctgacttaatgatggctgagtgataaataggcgactggctgcccgaccataatgtaattcatcacacaatatcaggaaggagtgtagttgtttgatattcattaaaatttaatgccaatcgattgggttttgttataacgattataaaaaataccaaattgtttgcctattttgctttttttaaactgtgatcagtgcattttaaaaagggaaaattatgtcggcatcaatcaaccgctggggaatgcttgccgctcacgtgtgcatcaattttgtgctcgggggcgtctacgcatttagctatttcaaaacaccactcatggcgcaatatcactgggatccggctacgccggcgttagcattctctatcaatatggggatcattcctttaccgatgatttggggcgggagaatgatcgacaatggtaaaggaaagcaggcgatagttatcggcggtatcctgttttctttaggttttatcttgtccgggtttgtggataatttgcccatgctgtttttaacctacggcgtcattgccgggttgggatcgggcctggcttttacgggtaatcttaataatattctgaaatttttccctgaccgtcgcggtcttgccagcggtatcgtactggcgggtgttggcgtcgggacgctactttgcacccgcctggccgaatattttatggcgcaaactcacgatgttagtcgggcgttgttatatctgggtattgtttatctggtggttatttttatcgtccagttctttattcgtagcgcgccagcaaaagatagcggaggaattaaagcctcgccactggataaagactatcggcacatgctgaaagatctgcgcttctggctgctgtttatgattctggcgctgggcgtgttctctgggatggtaattagctcaagttctgcgcaaattggtatgacgcagtacggtttactgtccggtgcattagtcgttagcctggtctcgatatttaactcgatcggtcgcctgttctggggagggttaaccgataaattaggcggctataatacgctggttattgtttatctttttacctgcgtctgtatgctgctgctgttgttcttcaacggtaatacttcggtattctatttcagcgctctgggcgtgggctttgcttatgccggtatattagttatcttccttggcttgaccagccagaattttggtatgcgtaaccagggactaaactacggctttatgtattttggttttgccgtcggtgcggttattgctccttacgtcacgtccgctattgcaaaatataccggaagctacaatacagtatttattttgacaacggtgctattgcttattggagtcgtgttgaccctgataacgaaaaaatatgtcgcaacggttttagccaaaattcattaatcagataataaggaaataaaaatgaaaattgcaatcgcaggtgcaggcgctatgggatgtcgttttggctatatgctgctggaggccgggcacgacgtgacgcttattgatggctggcaggagcatgtcgacgctattcgtagcaaggggttgtttgtcgaaacggaaacgactcagaagtattaccccatccctgctatgttggctgatgaatcccagggggagtttgagctggttattctgtttaccaaagccatgcagttggatagcatgttacagcgtattaagccgctgctgccagccgcgaaggtcgtgatgattttatctaacggcctgggaaatatcgaaaccctggagaaatatgtcgatcggcagaaaatctatgcgggtgtgacgttatggtccagcgaactggagggggctgggcatattatggccaccggtaccggaacgattgaactgcagccgatagccagccaagattcggctcaagaggctaaggtcattgccacccttaatagtgctggattgaatgctgaaataagccctgacgtattattatcgatctggaagaaagcagcctttaatagcgtaatgaacacctattgcgcgttactggattgtaatgtcggcggatttggtcagcggcctggtgctttagatttagcgcaagcggtagttgatgagtttgtgttagttgctgccagccagaatattccgttgactgagcaaatggtgatgaatacggtgaagaaagtgttcgatccgcgtgagagcggccaccactatccttctatgcatcaggatttacataaaggccgactgaccgaaatcgactatttaaatggtgcgattgcgcgaatcggcgctcagaacaatattgccgtaccggttaacacactcctgacgcaattgattcacgctaaagaagcgcaataaacttgatagctcttctgcatgaggcggaagagccattttcaaaccagtttttttaccagcgcctcgctatggcgaatacgctccggcgcccgctctaaatcctgttgtaccagcgccataaacagtaagtcggtcaacatcatttgcgcatgtgtcgaggagatagcggcgctacgcgtcgcctgctcttcggcaatcgtatacagacagcgggtggcgcgctgctgcaaggcgttgggagaaaaaccggtaatggccaggattttcgcgcctgcgcgtaatgtttcgtccgccgccaggttcagctcgcgccgctccccggaataagagatcgccagcagcagatcctccggcgccagcgcctgcaccgtcgccagcagggcgtgcatatcgcgctcaaccaccgcgttaatgccaatcttcagtagcttccaggcaaaattttgcgccaccagcccagaggcgccaattccggtgatcacaatacggcgggcgtggcgcagcatcgtgacgctttctaacagcttttcttcactgttaacgtccagcgtggcgtgcatcgccgccacattctctttaattaatttttccccgaccaggcgcatcggatcgtcgccgcgaatctggttatgaacgggaacggaatgcggattaggattgctggccaacgcttcgctgatagccagtttcaacgccggaaaccctttaaaccccagtttttgcgcgaacttgactacgctggattggctgacgcccgcttcggccgccagttgctgcgagctcagatgtcgcgccgtatccggttgcgcgagcagataatccgccagtttcctgtcgctttgcgcgagatccggataacgctggcgaatacgaatcaaacagttcatgggcagctcctgcgaaacgtgatggcgacgacaaaacgaaatttcactcgcctgggggaatattctattccatcatggacgcttattatgaattaaaaattccagagggacaaaaatgaatcttggtaccttagtgtctgaaacccgtaacccgcaaacgatggatctggatgcgttgtctactcctgaattagttaagcgttttaatgaacaggatacgctggtagcggaagcagtaaaagccactctgcctgacgttgcgcgtgcggtggatgctgctgcggcggcgctgaagtctggcggacgtatcatctatatgggggcgggcaccagtggtcggcttggcgtactggatgcctcagaatgccccccgacgtttggcgttccgcacggtctggtcgtcgggctgattgccggcgggccgggcgcgttgctgaaggcggtcgaaggcgcggaagacagccaacaggcaggcgaagacgatcttgtcgcgctaaatctgcaagaacaggatctggtcgtggggctcgcggcgtcgggtcgtacaccctatgtgattggtggcctgcgctatgcgcgacagtccggttgtaccactgttgccgtctcctgtaatccagattcgcctattgcgcgggaggctaatatcgctatttcgcccgttgtcgggccggaagcgcttaccggctccacgcggctgaaatccggcaccgcgcagaaaatggtgctcaatatgatttctaccggcgcgatggtgaagttcggtaaggtctatcagaacctgatggtggatatgaaagccaccaacgtcaaactggtcgatcgcgcgtgtcggatggtcgttgaagcgaccgggataggtcgtgaagaggcggaaacgttgctgaaacagaccgattttgaggttaagcccgccattttgatggcgcttacggggctggatgctgcagccgccagggaaaaactcgccgctcatcagggctttttaagggcggcgttagaacactaaagaggtgtgtatggataagacggcagcgctcgccagcgacattttacgtggtatcggcggagagcaaaatattctgcgcctggaaaactgtatgacgcgagtcagagtggaggtacaggacgacagccaactggatattccgcgcttaaaagcgttgcctggcgtcagtggatacgtaaagcaaggggagcaacatcagctgatcgttgggccggggaaggctgcacaggtggttgatgcgatgcgcgtgcagattgccgcaggtggtgtaaagccggacgatgctatggcgcgtaccaaatccgaggcgaaagcgaagtataaagcgccgatgagcgatgcgttgcgtaagctggcgaatgtttttattccgcttattcccgcctttatcgcatccggcttgattaccggcattatcaatattcttaaacgcccggatatcgtcggcgatgttgccgtccactatcctaacctgctgggcctgatggggatatttggtagcgcggtgttcgctatcatgaacattctggttggcgtcaataccgcgaaagtctttggcggatcgcaggcgttaggcggcgtgatggcggggatcctttccagcccgcaactggcgcagattacgctctttggcgaggcgcttcagccgggacggggcggcgttatcgccgtcctgctggtggtggcgttaatgtgctggattgagcgccagttccgtaagctgctgccggggtcgctggagttaattcttaaccctttattgacgactgttatcaccggcgcggtagcgattgtcgctctgcaaccgcttggcggctggatttcagacgctatcgctcacggcgcgtcctgggctatcgatcgcggcggttttctggtgggcgcggtgttagccggaaccttcctgccgttggtactgatcgggctgcatcaggggctggtgcctattcatgtggagctggtgcaagcgcacggctataacgcgctgtttcccatcctggcgatggcgggggttggtcagataggcgcggccattgccgtactgatgaaaacccgcaatgcgcggctcaaaaaggtgattaaaggcgcgcttccggtcggactgctggggattggcgagccgctgatttttggcgtcacgctgccattgggtaagccatttattggcgcttgcctcggcggcgcggtaggcggggcgttgatcagctactggaaagtggcgacggtaattacctttggtatttccggtttgccgctggcattaacaattgttgccggaaaagtcctgttctatctgttaggctatttaatagcggtaattgccgggtttatttttacctggctgctggggttcaatgatccagaggagtaaggtttggtcagccacgagcgtcgtgtcgtcttttttgatttggatggaacgttatatcaacaggatatgttcggcagttttctgcgttatttgctgcgccgtcagccgctaaatgcgctgctcgtactgccgttgttgcccattatcggtatcggtttactggtaaaagggcgtgcggcccgctggccgatgagtctgttattgtggggctgtacttttggccatagcgaaacgcgtttgcaggcgcatcaggcggattttgtccgttggtttcgcgctaacgtcacggcgtttccggtcgtacaggagcgtctgaccacctatctattgagctctgacgcggatatctggcttattaccggttctccgcaatcattggtagagcaagtctattttgatacgccgtggttgccgcgtgttaacctcatcgccagccagatggcgcgacggtatggcggctgggtattaaccgtgcgctgtctgggccatgaaaaagtcgcgcaactggaacgtaaaatcggtacgccgttgcgtctttatagcggctacagcgacagcaaacaggataacccgctgctttatttttgccagcatcgctggcgggtgacgccgcacggcgagttgcagcagctcgaatagtgaaacgcatagcgtctgtgtataatgccgcccgctttcattaccggagttacctctttgtctgatgtcgaattagatcacgaatactggatgcgccacgcgctgacgctggcgaaacgcgcctgggacgaacgcgaggttccggttggcgcggtattggtgcataaccatcgcgtcattggcgaaggctggaatcgacccattggccgccacgatcctactgcgcatgctgaaataatggcgctgcgtcagggcggtctggtattgcagaattatcggttactggataccacgctgtatgtcacgctggaaccctgtgtgatgtgcgcaggcgctatggtgcatagccgcattggacgcgttgtctttggcgcgcgcgatgcaaaaactggcgcggccggatcgctaattgacgtgctgcaccatccgggaatgaatcaccgggtcgagattattgaaggggtgttgcgcgatgaatgtgcgacgctgctcagtgattttttccgtatgcgtcgtcaggaaattaaagctctgaagaaagccgaccgtgcggaaggcgcggggccggcagtatagcgcaatgccggataagacgttgcgcgtcgccatccgataagaccatcgcgctatttttcttctttcttctgcggcgtaaacagtaaagacggcgaatgcgtcaggtagcctgatgactgcgataaaaacgacaggaaggggaagggggctttattcagctcctccggctacaccgccgggtaatcctgcgccagtttcatagcttccgcttcctgcttttctttttcctgcaaataccccaccaaacttatctggtatttacggatattttccacataagcataagcctcatgtccacgcgcgtaaccgtaggttagcttactgtaatacggtttttggcttaacagaggcaaacgctgcttcacatcggtccagctatccggattgcctttggtttttaccgtcagcgatctggcatcgagcatgtgcgcataacccatattgtaggcggctaaggcaaaccagatacgctcgtcttccggaacggtttcgggaactttagccatcatatcttcaagatagcgagcaccgccgctgatgctttgctccgcatcggtacggtcggtcagccccagactttgggcggtatttttagtcagcatcatcaggccgcgcacgccggttggcgaggtcgccagcgggtcccagtgtgattcctgataagaaatcgccgccagcaggcgccagtctatctctttggcatattttttaaataacggttccagctccggcaggacgttatccaccgctcgcaggaaagagcgggtatcaacgtagtcgaaatcatcgccatgccccagatatttctcttcgatccgcgccaacgacccgtcttcattgatcgaattgaaaaaatcgagcagcgcggcggagagcgtattatcgtcgtccagtcggctaaaccaggtcacgggctgttcatccgtgacatccagcgccacggccagttcgggatggacgcgctgaaacagactgatcgccactgaatcggcaatggtgtaatccagtttgccgctgatgacctcttccagcagcgtcgtcgagccttttttatcatccaccttccagctcaggtcgggaaactttgtctcttttaaacgctgtaaatcattgaccacgacgtgccctggcgcaatggtaagctgattctcgttaacggtcgccagcgaacgtgggcgatattgtccgacccggtaaacgagctgttgcgaaaccgaataatacatggggccgggctgatagtttttaacgcgcgcgctgtcgtagaccagccctgccgcgagcaggtcggcattgccgttatccagatcgtcaaacaactggctgatattctggcgcaccgtcactttcagcttcacgccgagatagttggcgaactgctgcgccagttcatagtccagaccatattttttaccgttgataacggaataggttaatggcgagtcgatcgtactgacgcgcagtaccccccgggcttgaatcgcggcgatatggttttcggttttaccgaaccaggggattgagggccaaagggctgctgccagcagcagcgtcaatatgccgatgaacagataattaatctttaattttttcaattagttaattctctggatcgtgcgttgcctcgggctgaaaaagatgttttgctgcaatagataagtcactaatgagcggcattttgcgtaacaatgcgccagttggcaacttattcgcaacgatagccgcaccgtatgacaagaaaaagcggtgattttatttctacgcaaacggtttcgtcggcgcgtcagattctttataatggcggccgtttccccccttgcgcacaccgaagcttagaagacgagagacttatgatggaaattctgcgtggttcgcctgcactgtctgcattccgtatcaataaactgctggcgcgctttcaggctgccaacctccaggtccacaatatatacgctgagtatgtccattttgctgacctgaacgccccgttaaatgatagcgagcaggcgcagcttacccgtctgctgcaatacggcccggcgcttagcagccatacgctggcgggtaaactcctgttggtcacaccgcgtcctggtaccatctccccctggtcttcaaaagcaacggatatcgcccacaactgcggcctgcaacagattgaccgtctggagcgcggcgtagcgtactatatcgaggcttcgacgttgacggcggaacagtggcgacaagtggccgcagagctgcacgaccgtatgatggagacggtgttctcttctttaaccgatgcggaaaaactgtttatccaccatcagcctgcgccggtttccagtgtcgatctgctgggagaaggccgtcaggcgttaattgacgctaacctgcgtctcggtctggcgctggcggaagatgaaatcgactatttgcaggaggcgtttaccaaactgggatgcaacccgaacgatatcgaactgtacatgttcgcccaggcgaactccgagcactgccgccacaagatttttaacgccgactggattatcgacggtaaaccgcagccgaagtcgctgtttaaaatgattaaaaacaccttcgaaaccacgccggactatgtgctctctgcctataaagacaatgccgcggtgatggaaggatctgcggtggggcgctacttcgccgaccacaataccggccgttacgattttcatcaggagcccgcgcacattctgatgaaggtcgaaacgcataaccacccaaccgccatctctccgtggccgggggcggcgaccggttccggcggcgaaattcgtgatgaaggcgccaccgggcgtggcgcgaaaccaaaagccgggctggtaggcttctccgtttccaacctgcgtattccgggctttgaacagccgtgggaagaggattttggcaagccggaacgtattgtcaccgcgctggatatcatgaccgaaggtccgctgggcggcgcggcgtttaacaacgaatttggtcgcccggcgctgaccggttacttccgtacttatgaagagaaagtgaacagccacaatggcgaagagctgcgtggctatcacaagccgatcatgctggcgggcgggatcggtaatatccgcgccgatcacgtgcagaaaggcgagatcgtcgtaggcgcgaagctgatcgtccttggcggcccggcgatgaatatcggcctcggcggcggcgcggcatcgtcaatggcttccggccagtctgatgcggatctcgattttgcctctgttcagcgcgacaacccggaaatggaacgccgctgccaggaagtgatcgaccgctgctggcagttgggcgacgctaacccaatcctgtttatccatgatgtgggcgcgggcggtctctccaacgccatgccggagctggtaagcgacggcgggcgcggcgggaaattcgaactgcgcgacattcttagcgacgagccgggcatgagcccgctggaaatctggtgtaacgaatcccaggagcgctatgtgctggcggtcgcggctgaccagttaccgctgttcgatgaactgtgtaagcgcgaacgcgcgccgtatgcggtcattggcgacgctaccgaagaacagcatctctcgttgcatgataaccatttcgacaatcagccgatcgatctaccgctggatgtcctgctgggcaaaacaccgaaaatgacccgcgatgtgcaaacattgaaggcgaaaggcgatgcgctgaaccgcgcggatatcacgattgccgacgcggtaaatcgtgttctgcatctgccgaccgtggcggaaaaaaccttccttgtcactattggcgaccgtaccgtcaccggtatggtggcgcgtgaccagatggttggcccgtggcaggtcccggtagctgactgcgcggtcactaccgctagcctcgacagctactacggcgaagcgatgtcgattggcgagcgcgcgccggtggcgctgctggactttgccgcctccgcccgtctggccgtcggtgaagcgttgactaacattgccgcgacgcagattggcgatatcaagcgcattaagctttccgctaactggatggcggcagccggtcatcctggcgaagatgccggtttgtatgacgcggttaaagcggtgggagaggaactctgtccgcagcttggcctgacgattccggtgggtaaagattcgatgtcgatgaaaacccgctggcaggaaggcaacgaacagcgcgaaatgacctcgccgctgtcgctggtgatttccgcgtttgcccgcgtggaagacgtgcgtcacacccttacgccgcagctgtcaacggaagataacgccttgctgctgatcgatcttggcaagggccacaacgcgctgggcgcaacggcgttggcgcaggtctatcgtcagcttggcgacaaacccgcggacgtgcgtgacgttgcgcaactgaaaggcttctatgacgccatgcaggtgctggttgctgcgcgtaaattactggcatggcacgaccgttccgacggcggtctgctggtgacgctggccgagatggcctttgccggccactgcggcgtgcaggtcgatatcgccgcgctgggcgatgaccatctggccgcactgttcaacgaggagctgggcggcgtgattcaggtacgcgctgaagacagagacgcggtcgaaacgctgttggcgcagtacggtcttgctgactgcgtccactaccttggtcaggccctggctggcgatcgctttgtgattaccgctaatgatcggacggtattcagcgaaagccgtactacgctgcgtgtctggtgggcggaaaccacctggcagatgcagcgtctgcgcgacaatccgcaatgtgctgaccaggaacacgaggcgaaagcgaatgatgccgatccgggcctcaacgtgaagctgtcgtttgatattaatgaagatatcgccgcgccgtacattgcgacaggcgcacgaccgaaagtcgctgtactgcgcgagcagggggtgaactctcacgtggagatggcggcggcgttccatcgtgcgggctttgacgcgattgacgtccatatgagcgacctgctgggcggtcgtatcggtctgggcaacttccatgcgctggtggcttgcggcggcttttcctacggcgacgtgctgggggcgggcgaaggctgggcgaaatccattctgtttaaccatcgggtgcgcgacgaattcgaaaccttcttccatcgtccgcagacgctggcgctgggcgtgtgcaacggttgccagatgatgtcgaatctgcgcgagctgatcccgggcagcgaactgtggccgcgttttgtacgtaaccattctgaccgcttcgaagcccgcttcagcctggtggaagtgacgcaaagcccatcgctgctgctgcaaggaatggtaggctcacagatgccgattgcggtttcccatggggaagggcgcgttgaggtgcgtgacgatgcgcatcttgccgcgcttgagagcaaaggcctggtcgctctgcgctacgttgataactttggtaaggtgaccgaaacctatccggctaacccgaacggttcgccgaacggcatcacggcggtgacgaccgaaaacggtcgggtgacgattatgatgccgcatccggaacgcgtattccgcaccgtcgccaactcctggcacccggaaaactggggcgaggatagcccgtggatgcgtatcttccgtaatgcgcgtaagcagcttggttaattagcccgatagccattaagcccctcttcacgaggggcttttttgtagacggcgcttatcaggcccacggggaagcgcggttgtagctaccgtcttgaacgtcaagcggtagggcggataaggcgtttacgccgccatccggcaataaactagcgcttatgccgcaagattaaagtgtcgggaaatcccgacatgagtggggataggttgtcgccaaaaagagacatttaactatttgattttaaatgattttatttttaggtgttgcaggtgttgctgattgacgacagaaaggacaaaaaacagacagagccatttttagcatgaataacgatatttttcatatctatcattgtgttaacaaagtcttttgaatgttggcacaattactgcataatggtaaccagtggctcattcaccttcttatgtcagccccttagggacgcgctacataaacttcgaatgacgcacaacaaggtgcctgccgtctaacttctgataatagcgtagctttatcaacctccgggcgaaacgtcgagttaggcaccgccttattccataacaaagccgggtttagcccggctttgttgtatctgacgctcccctcggttagcatcttttttattcttctttttatgtgagcgacacgttgaagcgctggtctgttttcccccgttctttacgacaattggtcatgctggcctttttgctgatcctgctgccgttgctggttctggcctggcaggcgtggcaaagccttaacgcgttaagcgatcaggctgcggtgactaaccgcagcacgcttattgacgcccggcgcagcgaggcgatgaccaacgtcgcgctggagatggagcgaagctaccgacagtattgcgtgcttgacgatccgacgctggcaaaagtgtatcaaagccagcgtaagcgctatagcgatatgctggatgcccatgccggcgtcttgccggatgataagttgtatcaggcgttacgccaggatttaaacgcgctggcgcaattgcagtgtaaagatagcggcccggaagcggcagcggccgcgcgtctggaggcctttgccaacgcgaatacggaaatggtgcaggcgacgcgtactgtggtttactcgcgcgggcagcagttacaacaagaaatcgccgagcgcggacaatttttcggctggcaggcgctggtgctatttctggtgagcctggcgatggtgctactttttacccgcatgattatcgggccggtgaaaggaattgaacggatgattaatcgcctgggcgaaggccgttctttggggaataccgtcacctttaccggtccgcgtgaattacgatcggtggggcagcgcattatctggctgagtgagcgtctggcgtggctggaatcccaacgccatcagtttctacgtcacttgtcccatgagctgaaaactccgctggccagtatgcgcgaggggacagagctgctggccgatcaggtggttgggccgctgacgccggagcaaaaagaggtggtcgatattctggatgacagcagtcgtaatttacaaaaattgattgagcaattgcttgattacaaccggaaactggtagacagtgccacagagctggaagcggtcgatatcgcgccgcttgtggatatggtggtttccgcccacagtttgcctgcccgcgctaaaatgatgcataccgatgtcgacctggaggccgaacgctgcatagcagagcccatgttgctgatgagcgtgctggataatctctattccaacgctgtgcactatggcgctgaatccggtaacatttgtatccgtagtcgctctcagggctccacggtttatatcgatgtggttaatagcggcgaaccgattccgcaaaccgaaagagaaatgatttttgagccttttttccagggaagccaccagcgaaaaggggcggtaaaaggcagtgggttagggctgagtatcgccagagattgtattcgtcgaatgcagggagagatccagctggtggatgacaaagcgcaggaagtttgttttcgcatctcgctgccattgcctgcatctgacaaacactaatatgaatttaagcctggtgcgtatgtcacacgttttcgtccaaactattaaacgatgccttttgcgatggggaataccggtgggcatatcgtgtctggcgctgaccgcatgtgttccccatgcttcacagcaactgcccggtagcgcagcgcaggacacgctcccccattatcaactggcggattatctcccgacggcgtgcgcggatatctggtcgctacgcgggcaggcggtggagacgaatccgctgtactggctacgcacgattgactgcgccgatcgtctgatgccggttcagtcgcgcgcagaggcgcgcgcgttgacggatgataactggcagaatgccttcaggcgcgggattttactggcggatgcaaaaattacgccgccggagcggcgcgccatagtgacccgtctggaggcgttaagcgcgcaaataccggctcaggtacggcccgtctaccaaatctggcatgacggtcaggcgctgcaattagcgctttctgccgaacgtcagcgttatagcaaactccagcaaacgtcagatagtgagctggatgcgttgcgccagcagcaacaggccttgcaaacgcagctcgatcttactacccgtaagctggagagtttaaccgacattgagcgccagctttcgacacgaaaaccggcagggaattacaacgccgatacgccgcatacgaatgacaaacccgcgacgtctgaagatggcgcggcgccgtcgccgtcacaagatgaggtaacgccatgataagccgtaaaccggcgcacctgctgctggtcgatgacgatcccggattactgaaattgctcggtatgcgcctgaccagtgaaggatacagcgtcgtgaccgcagagagcggccaggaaggactacgggtactgcatcgggaaaaagtggatctggtaataagcgacctgcgcatggacgaaatggatggtatgcaactgttcacagaaattcagaaagtacagccgggaatgccggttattattctgacggcgcatggttctattccggatgcggtggccgctacccagaagggcgtattcagctttttgacgaagccgatcgacagagacgcgttatataaagcgatagatgaagcgctggagcagtccgctcccgcgacggacgatagctggcgcaacgctatcgttacccgtagcccgctgatgctgcgactgcttgaacaggcgcgcatggtcgcgcagtcggatgtcagcgtattgattaacggacaaagcggcaccgggaaagagattttcgcacaggcgattcataatgccagcccgcgcaataacaagccgtttgtcgccatcaactgcggcgcgttaccggaacagttgctggagtccgaattattcggccatgcgcgcggcgcctttaccggcgcagtgagcaatcgtgaagggttgttccaggcggcggaaggcggcacgctgtttctggatgaaattggcgatatgcccgcgccgttacaggtgaagctgctgcgggtgttacaggagcgcaaagtcaggccgctgggcagcaatcgcgatattgatatcgacgtgcgaattatttccgcgacgcaccgcgatctgccgaaggcgatggcgcggggcgaatttcgtgaagatttgtactaccggctgaatgtcgtgagcctgaaaattccggcgctggcggagcgtaccgaggatattccgctgctggctaatcatctgctcagacagtcggcacagcggcataaaccgtttgttcgcgccttttctactgatgcaatgaaacggctgatgacggcaagctggccgggcaacgtgcgccaactggtcaacgtcattgaacaatgtgtggcgttaacctcttcgccggtgatcagcgatgcattggtcgagcaggcgctggaaggcgaaaacaccgcgctgccaacttttgccgaagcgcgaaaccaatttgaactgaactatctgcgcaagttactgcaaattaccaaaggtaacgtgacgcacgcggcaaggatggcggggcgcaaccgcacggaattctataagctactctcccgtcacgaactggatgcgaatgatttcaaagagtagttttcatgccgtaaagtagcgcgaaatatgttacgtttaaccgatcaaaacacaggcgaccttttcaaggaatagcatgaaaaagattgatgcgattattaaacccttcaagctggacgatgtccgtgaagcgctggccgaggtaggtattaccggtatgacggtcactgaagtcaaaggctttggccgtcaaaaaggccacaccgagctgtatcgcggcgcggaatatatggtggattttctgccgaaggtaaaaattgaaatcgttgtgcctgacgacatcgtggatacctgtgttgataccatcattcgtaccgcgcagacggggaaaatcggcgacggtaagatctttgtctttgatgtcgcccgcgttattcgtatccgtactggcgaagaagacgacgcggctatctgatgtgccgattcgctgcccgtctcctccttgtgggcagcgaaccaccgtttaatcgccctgcggtagcgccgatgtagtccgggtgcaaatccatctcaggccgacaatggcgacgatcagcgccacgcaacttagtgtccactcgctcatttgcgagaaaaagtgtccgtaggcggctaccgccgtatcactaatttgcgattccgtggtttgttgcgcgacgacgccagccagccagttagcgatcgcgccggtcgccagcatataaataccggtcagtacgcccgtgacgccaggcagattgaggcgggtaatttgcgccatcgcgaccggatcaataaacagctccgcaaagcccatcagcgccagccctgcgatcatcattcccattgatgcctgcccatctaaccgggcctgatgcgcgtttagcgccagcagcataaaaccgccgcccattaatatcagccccacggcaaatttaagccagacgcgcagcaccgagcgggcgctctctttcgggctgctcagccacgccagcaccacgcccgccgccatcaccgcaatcgcattgaccgactggaacaatgcggtggggacggtcatattcagccagtggcggttgacaaaacggtcgatgaataaactgatcgaacttccgccctgctgcgccagaacccaaaagagagtgccggtgatcattaacagaacgatttgccacaaggcgcgacggtgttcgggaaatttaaccataatacgggcgataagttgcgccgcgaagacgcagacaatggccagcacatagccagaccagttattttccagcaggagggtgaagaataccggcgcgatacacagcattaataccagccaaccccaggttggaagggcgaatttaaccgcccgcagcgcggggcgattaacaccgcgcgtctgctgaaagtggcgatgaccgcttaaaaagatgagcaggccgatgaacattccgacgcccgccagcgcaaagccgacatgccagccataccactgcgccgccagaccacaggcgatcggcgcggctatcgatccaatattcccggcggcgtagagcagcgagaatcccccgtcgcggcggttgtcatcaggggcgtaaagttcgcccagcagacagctaatattggatttaaacaagccgtagccgcagataataatggccagcgccgcatataaactcagcgttgaatcagattctaagcccaataccacatgacccagcgtcatcaataaggcgccggtgataaccgccacgcggttgccaagcaggcggtcggcaagccagccgccaagaataggggtaacgtaaactaaagaggcgtaggcgctgaagaggttgatcgcgtggctgtcattaaaaccaagctggtgggtaagataaaggatgagtaaggcacgcatgccgtaaaagctgaagtattcccaaatttgaatcgccacgatgtaaaaaatcgcgcgcggttgtgagggtgttttcataaagtctccttgctgcgtgaaaaaagggaagtggcaagccacttccctttggtacttatttcgtattttctttcagcaccttaacggtgtaacgtccgtcagcctgacgataggcgccgtggatatcggtttcgaagcccggatagtgagcgccgatttcgcacagcatttgcaggaattccagtaccggacggctttcctcggtgatcatttcaccaggcatcaccagcggcactcccggagggtaaggaaggatcatgttggcgttgacgcgtccaaccatctcttcaagatacacctcttccgtttcgccatgcagctctttctggaacgcagtatacggcgtcatcaccattttcggcagcacttcaaacgcacggtacattaagtccggcagattatgatgttcgaccagtttatgaatattctgcgccagttcctggatgcgcatattttcataaaactcaggcgcttcgcgatacagtgccggcagaatgtttttgacgcgcaggttcaggtcaaaggcgcgtttaaattcagtgagcgcgcgcagcaggctcagagctttggttttgtcgataccaatgctgaacaggaacagcaggttgtatggaccggttttttctacgatgatgccgcgttcatcgagatatttggcgaccagacttgccggaataccgaattcatccatcgtaccgtctttcttcatccccggcgtcaggatagtgactttgatcgggtcgaggtacatgtgttcgttatcgatatttttgaagccatgccatgcgctatctgaacgcagcggccagcactcagctccatcgatatgttccggctgccatacgtcaaagaaccagccgtcagattcgcttttcaggcgtttaatttctttacggaatttaatcgcacgttcaatagagccgttaatcaggcgtttacccgcattacctttcatcatcgccgctgcggtttcagtagacgctacgataccgtagtgcggagaagtggtggtatgcatcatgtaggcttcgttaaaggtttcttcgttaatgtcgcctttaacatgaatcatggatgcctgtgaaaacgccgccagcagtttatgcgtggactgggtttcataaatgattttgccttctacacggtcgccgctcataccgcatttaccctgataaataggggagaaattggtgtaaggcacccaggcggagtcaaaatgaatggacttcacatccagagttttcttgatgtagtcagtgttatacaacagaccgtcataggttgagttagtaataacagcatggaccggccaggtggcgttaggcgtctcttttacccgtttagcgatagtggcgtgctggaactcgctttgcggaataccgccaagaataccgtaggcgttacgggttgggcggaaataaatcggcgtaatgtcgctcatcatcatcagatgggtcagcgatttatggcagttacggtcaatcagtaccgtgctgcctgccggcgcggagtacataccgacgattttgttcgccgtagaggtgccgttcgtcaccatgtagctacgttcggcgttaaagacgcgggcgatatactcttccgcttctttatgcgggccggagtggtccagcagcgaacccagttcggaaacggaaatcgaaatatcggatttcatcgtgttcgggccgaagaaatcataaaagatgctgccgacggggcttttctggaaagcagtaccgcccatgtggccaggcgtacagaaagtgtatttcccttcgcgcacatatttgaacagtgcttttgtcagcggcggcagaatattgtcgatgtattcatcggtattctggcgaattttcgccgcgatatcggctgcggcgcctaaagcatattcaaagaagcgaacctgcattctcagatcgttgaggctgacgtccagcgtagagtagctgttggcgaaggcatacagcggcatatactcgttcagcttgctaatctcttcgcaaagctcaaggttatatttatcccagtcgaaaatgacgccgcaaaggcgggagttattttcaatcagcttcagcaggtcttctcggtcgtttggatagacgatacggaaatttaaaccttccagtgcacgatgcagttcacgaataggctcttctttaaagtagacgcccatgtggttcatgatagcaataacgttcatagtcttgttcctggtaaagtgggcccctcccgctacgctatagcaggtgacgaaaggggctttgagaaaaaggagttagcggttaaagcgcttcagccgtattgttgtcgctgtcgttgttctggcgctggtgcattttgcgaccgtagaacatcaggatgatcagactgacgataaaggtgccggagagttcgaaggagctggcgcccatcagtgcgatgaagcaaaatgcgcagcccagtacagaacaaatcaggcttaccgagttacggatgttgaacccttcgaaacgaatcaggtcaacacaagagtagaagtacggcagcatggtaagcagtacggcaatcccggtcagttcgccgaacaggtcggacgctttaccgccgctggagttcatgatggtgatcagaatcatcagcgccgtcattttcaccgcagccaacagcagaccttttttcggaataccgtttttatccatttcaccgtaaattttcgggaagttgccgtcgttggcggcgcgaaccccagcctggccgaccagcatcatccaggagcccagagacgtcaggcaggcgaaagcggtaaaggcggaaaccagcggcgcagcccagccacccagaatcgtggaggtactgatagcgaacggcgcgccggaagaggccataacggaagctgggaacatcccggcgataacctgagtcgcggcgatatagatgatgcctgccagcgcggtacccagcatggttgccagcggtacggtgcgtttcgggtttttcaccatgccggtgctgacggcggcagactcaacgccaacgaacgcccacaggcagagcagaatacttttaacaatggcgtgagagtcggtcgtcgtagacgtgttccagttcgcgtgataggtcgcgatagcgaaccaatgccagccggcgactgcggtcaagactaccgggatcagcaccagaaacaggccaatcgttgtcaagcggctgacccaggccccgcccagcatattaataaaggtgaacagccagacgatagcaatacaggcaatacctgccggtattggattatttaatgccgggaagaacgtagaaagataagaaaccgcggtaataccgatggctaagttaccaatccagtttgcgtgataataaagaacgccggtctggaaaccaaacgccggagatatttccccagcataagcgatagggccaccctgttgcgggtttttggttgccagcctcgcataaacataagccagcgacattgccccaataatagaaattacccagccccagatggcaatgccaccaatactggcaaggttggcgggtaataatgcaatcccgctccccatcatattaccggcaacgacgccagtacaggcaaatagcccgatctttttgacagaactcatgttcatttctcctgagctgtatttttaagaaccgggcttatgcttcatatatgctgcgtgcccgttcaactgtcgacaagattaacgaatgggttgagataagtcctaaagaaaaagtgaaataaacacaaacatgaaaaaactgatagattgatttttttgaattaacatataaatatcatgaaaggataaatattgtttaattacaaagggttatatttacatttctttgcgatgaatatgttgccaaaattaacataagctattttttgcaacatatttttcacaaaataaaagcgaaaaatttaatatcttttcgcttttatttgtcatggttcagcgttaaatttaatcttctgccagaaaactattcagataagggacaattttctgaacggatgtctgaaatacgccgttctcgatccagtacagcgtattttcacctggacgtaaattaaaggcggtcagataggcatcagcggccagacgattctcacctttcatttcgtaaactttccccaacaggacatagttaaaccacgacatttcaagctcgatgcttttattgatttcctcatacgctgcatcgatatcacctttgcccaaaagatcaacggtcttgattttataataaacagacgttttctcaacgcccggaatttgatctatttttttaaactcttcgttcagcgcagccacttgttctttatcaaacggctgttgtgattgccgtaatacatctaccagcactttatattcataggcatagttgaaatcaggcgtttccttaataatgccattcagaatatcgccggctttacttagcgcctgcgcatcgccgctcagaataagctggcgcgcctcataaaaacgcatcagcgcggtattttgcggcgttctgaacagggccagttgttctcgcatacgattaggccagggctgtgttaaaacgaaagacaggctattaaacagatcatcctggatggacaactggttagtattggtgacgaaataacgcttatccagcatggttgaaccatcggcgttatcaatgagcaccacagacataaagcactgctgcgcccgatagtggcgctgattgacaaactgaatggttaacgtcttaccggagttgcttggctcattgacccggtaattggttttatcgtgcaccataaaggtcgagtaggtgttcagcaggtcggtgattaagccgcccagaccgatggcgtaggactcctgcgagacccagttattacaggaattgccgccttcaaaacgaacatctatatctcgtgggttaagtaataaccgcgtttttgttaccgcggcattatgatctaccaccgacatcacgataaacaccaccagcgtcgccagcgagagcaggaacatcacccacgtccagaaagcggcgatacgcggctttttcgcctttttagtcggcgtttgcaaagaggcgggcggcacaggcgcagcggcaggaaccccctctgtcggttctgcattcgtcgctgcgatcggcggcggcggcgacgttgataaattatcgatctcatcgctattttcttcgcaccagataaccggcgccgtcagcttatagccgcgtttaggtacggtaacgatgtattcagcattgctgtctccgccatctcttaatgatttgcgtagttcagaaatgctttgggtgacaacatggttggtcacgatggtgcgcatccagacatgatcaataatgttatcccggcttaacacttcatccggatgatgcgcaaaatacatcagaagatcgatcagccgtggttcaagagtaatctggcgtccctgacgactgatctgattaacagaaggtgtaaccagccactctccaatgcgtacaacaggttgctgcataaaaagatgccctaacgagctaagtcaaacgttaataataacacgatttgcacagacttttttattccccttttttgtaaaagaaaggcataaaaagcagcgcaataagcaggagaacggggaggaaaacgggcgttcgccttaacgataacgcccgttttttcagcggatttcttgcaattacagcactttatgcgggccgaagcattcgtaatgaatgttttcgttattcacgccaagtgaaaccagttgttttgcggcaaactgcataaagcctaccgggccgcaaagatagaactgcattgccggatcgctgatcgcggcttccagtttgcttaaatccatcagcccttcgctgtcaaagacgcgttgggcgcgatcggcctcggttggctcgcggtaccaggtatgggcagtgaaacgcggcagtgtacggcccagctcgctcacttcgtcggcaaacgcatggacgtcgccgttctccgccgcgtggaaccagttcacctgcgcggtatgctgttctttcgccagcgtatcgagcatcgccaacatcggcgtctggccgacgccagcggaaatcagcgaaacgggggtatcagcggcgacattcataaagaagtcacctgccggcgcagccagatgcaccacatcgcctacgttggcgtgatggtgtaaccagtttgatacctggccgccgtcttcacgcttcacggcaatacggtaccctttgccatcgggtttacgggtcagtgaatattggcggatctcctgatgcgcaaaaccttccggcttcagccagacgcccagatactgcccgggacggtattccgccaccgtaccgccgtcgaccggttcaaactcaaagctggtgatcagtgcgctacgcggggttttcgcaacgatgcggaaggggcgcgtgccttcccagccgccgtctttgctggcgttctcgtgataaatctcggcttcccgatgaataaagacgttagccagtacgccataggctttaccccatgcgtccagcacttcctggcccgggttgaacatttcatccagcgtcgccagcagatgcgtcccgacgatgttgtactgctccggcttaatctggaagctggtgtgcttctgcgcgattttttctaccgccggcagcaacgccggtaaattttcgatattgctggcgtaggccgcgatagcattaaacagggcttcgcgctgatcaccgttacgctggttgctcatattgaagatttctttgagctccgggttatgcgtaaacatacggtcgtagaagtgggcggtcagtttcggtcctgtttcaaccagcaggggaatggtggcctttactgtagcgatggtttgtgcgtcaagcatacgtgcttcctttatgtgaaaatctaataatgtatatcaaatgcatcttataaaaatacccttgcattgtaaatggatcttctctgctttacgttatggaggtaacaacgtgaaaaatctgcatcacaaagctgaaaagaaatccgttgaaattcgtcaggctctcgttcaggaaacccttatctgacgcataggtaatcgtttgcgtaaaaacctttgtcaagacctgttatcgaagaatgattcggttatactgttggccgaagtcccacggactgccttttcaggcacaaattttattgttagctgagtcaggagatgcggatgttaaagcgtgaaatgaacattgccgattatgatgccgaattgtggcaggctatggagcaggaaaaagtacgtcaggaagagcacatcgaactgatcgcctccgaaaactacaccagcccgcgcgtgatgcaggcgcaggggtctcagctgaccaacaaatacgctgaaggatatccgggcaagcgctactacggcggttgcgaatacgttgatgtcgtagagcagctggctatcgaccgcgcgaaagaactgttcggcgccgactacgctaacgtgcagccgcactccggttctcaggctaacttcgctgtttacaccgcgctgctgcagccgggcgataccgttctgggtatgaacctggcgcagggcggccacctgactcacggctccccggttaacttctccggtaaactgtacaacatcgtaccttacggtatcgatgagtccggtaaaattgactatgacgagatggcgaagctggccaaagagcacaagccgaagatgattatcggtggcttctctgcctactccggtgtggttgactgggcaaaaatgcgtgaaatcgctgacagcatcggcgcatacctgtttgtcgacatggcgcacgtggcgggcctgattgccgcaggcgtttacccgaacccggttccgcacgctcacgttgtcaccaccaccacccacaaaaccctggcgggtccgcgcggcggcctgatcctggcgaaaggcggcgacgaagagctgtacaaaaaactgaactccgccgtcttcccaagcgcgcagggcggcccgctgatgcacgtgatcgcgggtaaagcggtagcgctgaaagaagcgatggagccggagttcaaagtttaccagcagcaggtggcgaaaaacgccaaagcgatggtggaagtgttcctgaaccgcggctacaaagtggtgtctggcggcactgagaaccacctgttcctgctggacctggtggataaaaacctgaccggtaaagaagctgacgccgcgctgggccgtgctaacatcaccgtgaacaaaaacagcgtgccgaacgatccgaagagcccgttcgtgacctccggtatccgtattggttctccggcggttactcgtcgcggcttcaaagaagcggaagtgaaagagctggctggctggatgtgtgacgtgctggacaacatcaatgatgaagccaccattgaacgcgtgaaagcgaaagtgctggatatctgcgcccgcttcccggtttacgcgtaagcgtttgtgttgtgtaaatggcccgatggcgctgcgtctgtcgggcattacttatgcgccataacgtgacgccgccggaagtcattatccggcggcgttgccgtttgaacttctccctccgcctgttacccttgccagcgcaaccgtttaccgccagactatcgcctccaaacgggagggaatcatggcattgcattccacgcgctggctggcgctcagttatttcacctacttctttagttacggtatttttctgcccttctggagcgtctggctcaaaggtcttgggctaacgccggaaaccatcggtcttctgctgggcgtgggtctggtcgcgcgttttctcggtagtctgctcattgcgcctcgcgtaagcgatccttcgcggttgatctccgcgctgcgcgtcctggcattgctgacgctggtatttgcgctggcattttgggcaggaacgcatgtcgcgtggctaatggtggtgatggttgggtttaacctcttcttttcaccactggtgccgctgaccgatgcgctggccaatacctggcaaaagcaaattaccctggactatggtcgggtgcggctgtgggggtccatcgccttcgtgatagggtcggcgctgaccggtaagctggtgagtttatacgattaccaggcgattctggcgctactgacgctcggcgtcgcctcgatgttgctgggtatgttgttacgtcccagcgtgccgccgcaaggggaaagccgtcagcaggagagcgcaggctggcccgcctggcgtacgctggtggcacaaagttggcgttttctcgcctgcgtctgtttgctgcaaggggcgcacgccgcctactacggttttagcgccatctactggcagggggctggctattcagcatcggcggtcggctatttatggtcgttgggcgtggtggcggaagtgatcatttttgccctgagtaaaaagctattccgccggtttagcgcccgcgacttgctgttgctttctgctgtgtgcggcgtggtacgctggggactgatgggctggagtacggcgttgccgtggctgattgtgatacaaatcctgcactgtggcacgtttaccgtttgccatctggccgctatgcgctatatcgctgcgcgtcagggaagcgaggtgattcgtttgcaggccgtctattccgctgtggcgatgggcggcagtatcgcgattatgacggtatttgccggttttctgtatcaacatctgggcggcggcgtattctggattatggcgctggtggcattgcccgctatcttccttcggcccaaagtggttgccgcgtcatgattccaggatcttgcggatctgctgctgttggtgctctgtgagggcgcgatccgcatgaattaatggcggtgagaagagcggtagcggcgtggcgtaaggggtaacaatcagcgctacgccgcgcgggcatccctctttttgaaacgcctggagcgatatccgtctgatattcagcggcaatagggtcagttcacgcagttgctgctcaatatgcgtctccagcgcatcatttttatccgctaacaatacgatctgtctctcatgcaaatcgttatcctgcatcagccaggcgccgaaaatcactgccaccagccccgtctcttcctcggaaaagtggataccatattcggcttcaaacccggcgagcgcctcacgtgtggtgcgaaccagacgcggataaagacggttgaactcttccggaagcgtattatcgatgccaatcgtgaataaacttcggttcagcgcctgggcgagatggacatacagctgatcgttaagcccttgttcgtcgctgaagcgtacgttccctttttctcgaaagcgcagcaccagccgcgccacctccagtcgcagttgctgcgcccgttgatgcgtgtcgcgaatcgggtcggggaggcgaatcattgaaaacagtaacgccataaacagcgcttcattgagcggtgcggcctgcatcacgtggcgctgccagtgacgaccaatttcctgggcgagtggatattccgcacacgactgcgcccaaatctgctgtacaggattgaattccggggtgatgccggcatggtgttgtagcagacaatactgtaaaaagagacgcaggaactgcacgtcgcgatgttcaaatggtttttgcaaccggcgggcgcacagattgatgagcgcgtgcagattaatatcgtcatacagcggacgcgcgataccgcgctgctttagcgcgttttttaaggccggggtaaactgttgcgtgacgaaggtcgggcataaacgcaggccgcgcctgagccagtgtaaaaggcaaaggcgctgatcgagtgctgtaccttcgatccgatagcaaccgttctggcatgttgtgatggcaaggcgatgatagcgctggatctccaggcttgtgtcagtgatatcctcacgggcagtatcatcatcaacgccattaagcgcgctgaagatttccaccgtggcaattggctccggctggaaaagcgtcagcaatacctgacagcggcgctggggagcggaaagtacagatggtggggcaattgtcggcatcatctgtcaggtctcccgttagtttatctggtaaggatagctaaagtttgcatgtgaaaaatgtgataagtgtgcttttaggccaggaatgctgaggagtgtcacagaatttttatcgcgaggaacagatgaagccagtgaaacgcagcgccttaatactatttctcgccgttttatctttcgtggcggcggcgcatccgcacagcttcatccgtctgcaaacgcaggtggtcagtgaaaatgagcaatttgtggcgttaaaaatgcgctggacaatggacgcgctgacgtccgccgatctgctgtatgacgccggaaacgcggcgccgggttcagaaatatggaaaaagttggcggcggaagtgatggctaacgtacttgggcagcactactttacagaagtgtggcgcaatggcgcgaaagtgaagtttaaaaacaggccgacagaatacggtatgacgcgtgacgcgcatcaggcggtattgacctttacgctgccgctggctgaaccgcagccgttaagcggccagacttataccttttcaacgtttgatccctcttattatgtcgatatgcattatgaccaggacagcgatatcacgatgccggaaccgctgcgcgaaaagtgtcggattcaggtttatactcctgcgcccggcgaagagacgctacgtttcgcccagtcgctggataaagaggacgcgccgccggaggatatggatttaggtaaacagtttgcccaaacggtgaccttgcaatgtcagtaattttttctcaacgcactccggggcgacgctggctctcgctgtggccattggcgttattcctgctgctgatgctggttggcggtctgtggatatggcaggcctggccgcaggtgatgctgaaaagcgctctttggcagcgggacgtgaatcagcagttgagcgcgctgcttaatgcggtggcgacgcatcctgagcgggcgggcggatcgttgcttctgctgagttttatgtatggcgtgcttcatgcgtggggccgggacacggcaaagtggtgatcgcgacatggctggcgacgcatccttcgaagctgaaatcaagtatcgtgttaaccctcgccgccgcgttattgcagggggtcgtggctatcgggttggtggtgggcgtgctgaccgtattgcaacttccggccaggcagctccatctgagcggtttctggctggaaaaggggagctatgcgttagttggcgggctgggcatcttgctgtgctggcgggccataaaaaggttacgcgcgctgctacgtaaacctgtctttatcgcttttacgccgcgccatgttcaccatgaaaaatgcggctgcggacatcagcatctaccgacgcaggaacaattgcatagcggcgatgactggcgcgcgcgactcatgatcgtactgtctatggggatgcggccctgttccggagcgataatggtgctgttattcagtaaagtgattggcgtttttagctggggaatggcgtcggtactggcaatggcggcgggaacctcgctaacgattacttcgctggcgctgctggtacacacttttcgtgctctggcggtgaagctcagtggaaacaaagcgccggcgttatggcggcaggtaggctggtcaacgctggcgctggccggaggggtcatactgcttgtcgcggcgctggtcatgtggtttagcgtgccgcagcctgtgggcgggctgcggccatggcgtggttgactagtgcccggcgggtttgagatgcatccgcgcgacggattcgtcttcggcccagtaaatgcgttcggcgaccatcgcttccggattgagctgaacgccgcgcagtacccgttctttaaaacgcagatagccgcctttgtcgatcagatggcccatatgtagatagatcggttttccgccgagcatctctttttcaaattcatacaggttaacgatcacctgctttatcacatcttcagtcacccagttgaggaagagcttgccgacgcgcggcgtctttttactggtgcgtccgcccagacggacttgccagagctgatccggcttacgttgccaggccagcgtcggacaggccagcacgcactcgccgcagccgatacaggcggactcttctttgaccgctttgccgttcttcagcgccaggcagcctaccgcgtggtgactacaggccttcacgcaggcgccgcaaccgatacagcgatcggcagtgaagcgcattttcgccacgccaataattcccagatcggccattgacgccttcgcgcaatcattcgggcagccaacaatgaccgttttgagatgataagggctgggatagaccagtttttcaagacgacgggacagaccggtcgtgtcagtgttggctttctggcaaatgcggttcccctgacaggcgacaatatttcgcccgccaatagcgagatagcccgctttggtatcctcaacctggacgtcgcacagttctatttcaatctcgcgaagaaatggctccagcgcagcgttcacgttgtcgatatcttcgtaacggatacccggcatcgccagcttctggcgggtagtgaggtgaatttgtccgttgccccaggtttcggcgatgtcacgcgccaccgttagcaaatgcgcgggcaaaataccgccgggaatgcggacgctgatcatggcttcgccgcgcacttttgataggcgatattcgtttttcgcacgggctttaatgatatcaatatcaatgctcatgatgttctccttaatcggcaaaacgttgcgcgacggcgtagttaaatatcgggccgtcggtgcagacatacacttcgcccatacggcagtggccgcacttcccgacggagcaggccatccggcgttcgtagtccacccaaatttgctccggcttgagccctttttgcagcagcatttttacggtaaaggtaatcattattggcggcccaacgacgatggcctgcatggtgtcgatatcgctaagcgtcatgtcggcaagccgatcggtcacccgaccaatctggtaacggtcatcagcctcgccttcatccagcgtgagcaccagattatgtttgccgtgccacgtcgccatttcttctttgtacagcacgcaatcgcgatttttatagccgagaatcatatccagttgaccaatttcctggggattctcaacgaaatagcgcattaagcctttcaccggcgcgacgcccgtgccgcctgcgacaaccagtaagggtttatggcgcagagtatcgaccggatagccattgccatagcagccgcgtagccacacgttgtcgccttctttcagcgtaaagagggcgctggtcacttttccgacattacgaatcagcagatctatccagccatcgccgtagtcggaaacggagatgggcgcttcgccgacgcgcggcagcgacacctcaacaaattgcccccagtgcgcgggaaaatcgacggccacgcggaaattccactccagcggcgtgtggcgagtaatactgaggatgcggtacgccgcaggcagcaaactgtgctgcggtttatcatgacaggaacaatgtgacatgcgttatgcctcctctgccagcgcctgccgaacggcagcggtcattttgttaataatcaaagaaaatttgatgtattgcgggcagcgatcgtcgcagcggccgcagccgacgcacatatgttcaatgccgttgcgcgctttgtagtcattgaccttatgcagggcgcggtagcgcagacgctcgccgggtttttcgcgaaaaccatgaccgccggccatgtcgctaaagcccggcaccatgcagcttgcccactggcgacggcgttcgccgcgctgcggattttcatcataggcgacgtcaaagacgctatagcaggtacaggttgggcacccggtagtacagcggccacaactgatgcagcggctgtcgtaggcgtcccatagcggatggcgagtgagaatgtcgcgaattttttgcggatcgcggcaaacgctgtccggcgtgacgacggtttcccggttttcgctgacgaaagagggggtatagtcagcctcctgccccagtccttgtatcgccgcctcgataaagggatcgcggatgctcacaagcgcgccctcatcgctaaaacgcatggcggcgctataacagtcagttttattagtacccattgagacgcagaaacaattttcgaagctttcttcacactcaataaggacgaaacgaatatgctcccgtagcagttgataactgtaatcggaattattcccatttgataaatacatataatccagccgcgacatggcgttaatgtcgcaggcgcgggcaaagatgattatcggggaggtgtctgtctcggcaatttgaatggtgtttttatcgaaataaaagagcgtttcggtgataggggcgataatggtattcggcgacatgtgcgatttctcgtgccagatgagatcgcgccagccgctaatccgttgataaataatgttgtcagtgtcggaaaaacgcccgccgcgaaactctgcggacggggcaaacacgcgccattttttgtttaatcgctggataagcagactaaactcgtcaggcgtaattttgatagccatcacatactccacagtaatattcaggaaaaacaaatgaaaataaattgttataaaaatcagatgaatattactgttacgctagcgctaatccgccgccttcgctaacgggaaaaaatggtttttactatcggtataataaatatattcttaatcataaaatatgcatatatacagcgtcgcgctatttagcggatagcgctgtctgaataaaattaatcatcgcatcgcggtaaaggtttgcataacgtccggaaaaagcatcaatgtgatcgccgtcaggaatgaagattttttgtttgggctcccgggcgagggcatacaatttctcactgtcctgccagggaataacatggtctgccgtgccatgaagaatcaataccggaatggggctgacgctggcgatattgcgatccgcgctatagcggtcatcaagcaaatagccgctgcccgggatcatctggttggcgatggaggaataggatgaaaacgttgagtcgaggacaatcgcacgtatgcccgcctggtcggcgtagcgcatatttgcgcagcctacgcagtggcctacggcggccagtacattattgccgcccaggctctgccccagcagtaccaggcgctcggggttaacgtcggcacgatgccgcacataatctatcgcgcttttcgtatcgttcagtagcccctcttgtgatggggtgccctcagattcgccaaacccacggtaatcaaacataaacaggtttacgttgcgttctggcagccaactgactaacggccagtgcgccgacatatttccggcgttgccatggacatgaatcaccgtcgcgacggcgttttccggcctgccgaaagcagtaggaataaaccagccgtgcagatgcgtgccatctttggcggtaaaggtaatggattcagcttcggcaggggttggtccatagactttattgtccgggtaataaaaggcattgatcgctacgcggggtagcaggtaaatacagactacaatgataaacagaataaaaagggatttgacgatgcgtcgggtatgttgaagggtcatgttcgcttccttgccgctttatgtccatagcggagcagggagcgatcgtacaaaaacatgcaggcaagtaaagcgatgaggtggtgtttaggaaaaacgcctgaaaaggcacggcggatgagtggccccatccgccgaagagacttagcgcttcagcgcatcgctcagttcgtcgcgcatattcgccagcatggctttaacgacgcgcggattccccgccacgatattaccggtcatcatgtagttatgaccgccggtgaaatcgctgacgataccgcccgcttcacgaaccagcagttcgcccgcggcgaaatcccacggacgaaggccaatttcaaagaaaccatcgacacgacctgcagccacataggccagatccagcgcggcggaaccggtgcggcggaaatcggcgcattcggtgaacagcttgccgataatattaatgtaggtggtcgcgtattgtttggctttgaacgggaagccggtagcgaggatagtgccgtccagatcgcgcgcggtactgccgcgcagacggtagccgttcagctgcgcgccctgaccgcgggtggcggtgaacagttcgttacgcatcggatcgtaaacgacagccacttcagtacggcctttaatgtgtacagcaatggaaacagagaagtgtggcagacgtttgatgaagttggtggtgccatccagcggatcgataacccattgaacatcctgatctgtgccaacgtgctcaccgctttcttcggtgataatagtgtgttgcgggtaagatttgcgaatggtgtcgataattaccgcttcagcggccttatctacgttggtcacaaaatcgttactgcctttttggctcgcttctgcagcgtccggagtttcatagtttttggcaattacattacccgccttgcgcgctgcgcgcacggcgatggtcagcatcggatgcatcggtctctctcactggatgttaaagaacgggaaaacggcgcagagtatagcagcgagatcggaatctgtcttggttttatggtaagatgtccgaataatctttagctgaagaaagacaatgctgcaaaacattcgaattgtgctggtggaaacctcccacaccggcaatatgggctctgtggctcgcgctatgaaaaccatgggcttaactaacctgtggctggtaaacccgctggtgaaaccggactcccaggccatcgccctggcggcaggcgccagcgatgtgatcggtaatgcgcagatcgtcgatacgctggacgaagcgttggctggctgtagcctggtggtcggcaccagcgcccgctcccgcactctgccgtggccgatgcttgatccgcgcgagtgcggcttaaaaagcgtagcggaagcggcaaatacgccggttgcgctggtttttggtcgtgagcgtgtcgggctgactaacgatgagttgcaaaaatgccattatcacgtcgcgattgccgctaacccggagtacagctcgttgaatctggcgatggcggtacaggtcatcgcgtatgaagtccgcatggcctggctggcgacgcaggaaaacggcgacgcggcagatcatgaagagacaccgtatccgctggtggacgatcttgaacgtttttacggccatctggagcagacgttgctctccactggctttattcgcgaaaaccatccggggcaggtgatgaataaattgcgccgtctgtttacccgcgcccgcccggaaagccaggagttgaatattctgcgtgggattctggcgtctattgagcagcagaataaaggcaagtaaccgcgttaatgccggatggctcttcgcttatccgacctacaaatcgtgcggcctgtaggccggataagcaaagcgccatccggcacatcaataccgcacggaacgctaaatacctgactaatttactcaagtaaatagttgaccaatttactcgggaatgtcagacttgtccctgctatgcaatacccccattttacaataaaaaaccccgggcaggggcgagtttgaggttaagtaagacatgagactgacatctaaagggcgttatgccgtgaccgcaatgttagacgttgcgctcaactccgaagcgggcccggtaccgttggctgatatttctgaacgtcaggggatttccctttcttatctggaacagctattttcccgtttacgtaaaaacggtctggtttccagcgtacgcgggccgggcggcggttatctgctgggtaaagatgctggcagtatcgcggtcggcgaagtgatcagcgcggttgatgaatccgttgacgcgacccgttgccagggcaaaggcggctgccagggcggcgataaatgcctgacccatgcgctgtggcgtgatttaagcgatcgtctgaccggttttctcaacaatattactttaggcgagctagtgaataaccaggaagttctggatgtgtctggtcgccagcacacgcatgacgcgccgcgcgccagcggtcgtgcgcaggacgctatcgacgttaaattacgcgcttaattaaaatattacgccatctcttctggcggcctcatgcggtgaatgccgcggtcgtctgaaggatgaagcgtaaaaaagaattcagaatcaggccgggacgcggacgtcccgtcaacacggtcgtacatccagccggttgcctgattccttgcattgagtgatgtacggagtttaagagcaatgaaattaccgatttatctcgactactccgcaaccacgccggtggacccgcgtgttgccgagaaaatgatgcagtttctgaccctggacggaacctttgggaacccggcgtctcgttcacaccgtttcggctggcaggctgaagaagccgtcgatatcgcccgcaaccagattgctgaactggtcggcgccgacccgcgtgaaatcgtctttacctcaggggcgacggagtccgataacctggcgatcaaaggcgctgccaacttttatcagaaaaaaggcaagcacatcatcaccagcaagaccgagcacaaagcggtgctggacacctgccgtcagcttgagcgcgaagggtttgaagtgacctacctggcgccgcagcgcaacggcatcatcgatctcaacgagctcgaagcagcgatgcgtgacgacaccattctggtttccatcatgcacgtgaacaacgaaatcggcgtggtgcaggatatcgcgaccatcggcgaaatgtgccgcgcgcgcggtatcatctaccacgttgacgccacccagagcgtgggcaaactgcctatcgacctgagccaactgaaagtggatctgatgtccttctccggtcataaaatttatggtccgaaaggcattggcgcgctgtatgtgcgtcgtaagccgcgtattcgcattgaagcgcagatgcatggcggcgggcacgagcgcggtatgcgctctggtactctgcctgttcaccagatcgtcggcatgggcgaagcttaccgtatcgcgaaagaagagatggagaccgaaatggcccgtctgcgcggtctgcgtaaccgtctgtggaacggcatcaaagatattgaagaagtttacctgaacggcgaccttgagcagggcgcgccaaacattctcaacgtgagctttaactacgttgaaggcgagtcgctgatcatggcgctgaaagacctggcggtctcttccggttccgcctgcacctccgccactctggaaccgtcctacgtgctgcgcgcgttgggcatgaatgacgagctggcgcatagctctatccgtttctctttaggtcgttttaccactgaagaagagatcgactacaccattgatctggttcgtaaatccattggccgtctgcgtgacctttctccactgtgggaaatgtacaagcagggtgtggatctgaacagcatcgaatgggcacatcattaatcggtatcggaatcaggagaatttataatggcttacagcgaaaaagtaatcgatcactatgagaacccgcgtaacgtagggtcgtttgacaacaacgacgataacgtgggaagcggtatggttggcgcgccggcctgcggcgacgtcatgaagttgcagattaaagttaacgatgaaggtatcattgaagacgcgcgcttcaagacttacggctgcggttccgctatcgcctccagttctctggtaacggagtgggtgaaagggaaatccctggacgaagcgcaggcgattaaaaacaccgacattgcagacgaactggagctgccgccggtgaaaattcactgctctattctggcggaagacgcgattaaagccgctattgcggattacaaaagcaaacgcgaagcgaaataaaatagaacgttaacattgaggttttgttatgtcgattacacttagcgacagtgcagcagcgcgagttaataccttcctggccaaccgtggtaaagggtttggtctgcgtctgggcgtgagaacctccggctgctcaggtatggcttatgtactggaatttgttgacgagccgacggcggaagacaccgtgtttgaagacaaaggcgttaaggtagtggttgacggcaagagcctgcaatttctggacggtacacagctggacttcgtaaaagaaggcctgaacgaagggtttaaattctccaacccgaatgtgaaagatgagtgtggttgcggcgaaagcttccacgtgtaactgtgttccgctgttataccgagtcattcgtgctgcagaaaagcggcaagcgagtgaatccccaggcgcttacttaagtaagtgactgggggaacccgcgcagacaacgcatctgcggcgcgaagtaagaaggtataaccccaccgtggtcgcctgcgtgtggggtttgttctgacaggctatccctgagaatgttatggattacttcaccctctttggcttaccagcccgttatcagattgacacccaggcgctgagctttcgttttcaggatctgcaacgccagtatcaccctgacaaatttgccaacggcactcaggcgcagcagcttgccgccgtccagcaatccgccacgatcaaccaggcctggcaaacgctgcgtcaccctttgacgcgcgcggagtatctgctttccttacacgggttcgatctggccagcgagcagcatacggtacgcgacaccgcgtttctgatggaacaactcacgcttcgcgaagagctggacgatatcgaacaatcaaaagacgacgcgcggctggaaagcttcatcaaacgcgtacaaaagatgtttgatgctcgtcttcagcaaatggtggaacagttggacaacgccgcgtgggacgcggcggcggatacggtgcgcaaactgcggtttctcgataaactgcgaagcagcgcagaacaactcgaagaaaagctgctcgatttttaactggaatctaacatggccttattacaaattagtgagcctggtctgagcgccgcgccgcatcagcgtcgtctggcggcgggcatcgacttaggcactaccaactctctggttgcgacggttcgcagcggccaggcggaaacactgcctgaccacgaagggcgccacctgttgccttcagtggttcactatcagcagcagggccatacggtcggttacgctgcgcgtgacaatgccgcgcaggatacggccaacactatcagctctgtgaaacgcatgatgggacgctcgctggcggatatccaggcgcgctatccgcatctgccttaccggtttaaggcaagcgttaatgggctgccgatgattgacacggcggctggattgctcaatccggtacgcgtatctgctgatattctcaaagcgctggccgcgcgggctagcgaatcgctctccggcgagctggatggcgtggtgattaccgttcccgcctatttcgatgatgcccaacgtcagggaacgaaagacgccgcgcggctggcaggcctgcatgtactgcgcctgctcaacgaaccgacggcggcggcgattgcctacggtctggactcaggcaaagaaggcgttatcgctgtttacgatctcggcggcggtaccttcgatatctctatcttacgcctgagccgcggggtgtttgaagtgctggcgacgggcggtgattctgcgctcggcggcgacgactttgaccatctgctggcggactatattcgcgagcaggcgggaattgccgatcgtagcgacaatcgcgttcagcgcgaactgctggatgccgcgattaccgcgaaaatcgccttaagcgatgccgatactgttcgcgttaacgttgcgggctggcagggggagatcactcgcgagcagtttaacgatctcatttccgcgctggttaagcgcacgctattggcctgccgtcgcgcattgaaagatgccggcgttgagccccaggacgttctggaagtggtcatggtcggcggttcgacccgtgtaccgctggtgcgtgagcgggtgggcgaattttttggccgcacgccgttaaccgctatcgacccggataaagtgatcgctatcggcgcagcgattcaggccgatattctggtcggcaacaagccggacagcgaaatgctgctgctggacgtgattccactctctcttgggctggaaacgatgggtggcctggtggaaaaagtcattccgcgcaacaccactatcccggtggcgcgcgcgcaggatttcaccaccttcaaagacagtcagaccgcgatgtctatccatgtgatgcagggcgaacgcgaactggtgcaggactgccgctcgctggcgcgctttgcgctgcgcgggattccgccgctgccggcgggcggggcgcatattcgcgtgaccttccaggtagacgccgatggcctgttgagcgtcaccgcaatggaaaaatccaccggcgtcgaggcctccattcaggtcaaaccttcctatggcctgaccgatggcgaaatcgcctcgatgatcaaggattccatgagttttgccgagcaggacgtgaaagcgcgtatgctggcggagcaaaaagtcgaagccgcgcgcgtgctggaaagtttgaccggcgcgctaactgccgacgccgcgctgttaagcgccgcagaacgtcaatgcattgatgatgccgccgcacatttaagcgcggtcgcacaaggcgatgatgttgacgcaatagaacaagccattaaaaacgtagataaacaaacccaggaatttgccgctcgccgcatggaccagtcggttcgtcgcgcgttgaaaggccattccgtagacgaggtttaacatgccgaagattgttattctgcctcatcaggatctttgtccggatggcgcagttctggaagctgagaccggtgaaaccattcttgacgttgcgctgcgcaacggcatcgagattgaacacgcctgtgagaaatcgtgcgcctgcaccacctgtcactgtattgtacgtgaaggcttcgactccttgccggaaagttcggaagaagaagacgatatgctggataaagcgtgggggctggagccggaaagtcgactgagctgccaggcccgcgttaccgacgacgatctggttatcgaaattccacgttacacaatcaaccatgcgcgtgagcattaacagagggtagtatgggactcaagtggaccgatagccgcgagatcggcgaagcgttatacgacgcatatcctgatgtcgatcctaaaaccgttcgtttcaccgatctgcatcagtggatctgcgaactggacgattttgacgacgaccctaacgcatccaatgaaaaaattctggaggcgattctgctagtctggttggatgaagcagagtaagtcaaataacgggctgccctacgacggcccgtttgctaataaggaaaataacaatgacagaagccatgaaaattacgctttccacgcagcctgccgatgcgcgctggggcgataaagccacttacagtattaataacgacggtattaccttgcatcttaacggtaaagacgatctggggttgatccagcgtgcggcgcgtaaaatcgacggcctgggaataaaacaggtcgcgctgacaggcgaaggatgggataccgagcgttgttgggcattctgggcgggttacaaaggaccaaaaggcgtccgtaccgtaatgtggccggatttagacgatgcccaacgtcaggagctggataaccgcctgaccattattgactgggtgcgcgacaccattaatgctccggcggaagagcttgggccggagcaactggcgcagcgcgcggtggatctgctgtgcagcgtcgcgtgcgatagcgtcacttaccgtatcaccaaaggcgaagatctgcgcgagcagaactatatggggttgcataccgtaggccgtggttctgagcgtccgccggtactgctggcgctggattacaacccgacgggagacaaagatgcgccggtttatgcctgcctggtcggtaaaggtatcacctttgactccggcggttacagtatcaaacaaagcgcttttatggactcaatgaaatccgatatgggcggcgcggcgacagtaacgggcgcgctggcgttcgccattacccgtgggctgaataaacgcgtaaaactgttcctgtgctgcgctgataatctgatcagcggcaacgcgtttaaactgggcgatattattcgctaccgtaatggcaagaatgtcgaagtcatgaataccgatgcggaagggcgactggtactggcggatggcctgattgacgccagcgcgcaacacccgcggctaatcattgatatggcgacgttaaccggcgcggcgaaaacggcgctgggtaacgactaccatgcgctattcagttttgacgatacgctggcggggcgcttgctgaccagcgcggcgcaagagaatgagccgttctggcgtctgccgctggcggagttccaccgtaaccaactgccgtctaactttgcggaactgaacaacaccggcagcgcgacgtatcccgccggggcaagcaccgccgcgggttttctgtcgcactttgttgaaaattaccgcgaaggctggctgcacattgactgttccgccacttatcgcaaagcgccggttgagcagtgggctgccggggcaaccggtctgggtgtgcgcaccatcgcgaatctgctgaccgcctgaacggtgtttttgtaggccgggtaagcgaagcgccacccggcattttgcctgatggcgacgccgtgcgtcttatcaggcctacaacccatatacataatttgtgattcctatgtccgaaactaaaaatgaattagaaattttgctggagaaagcggcgactgagcccgcgcatcgttcggcatttttccgtaccttactggagtccaccgtctgggtgccgggcagcgctgccgaaggcgaggcgattgtggaagacagcgctctggatttgcagcactgggaaaaagaagacggcacgaccgtcattcccttctttacttctctggaggcgctgcagcaggccgtggaagacgaacaggcgtttgtggtgatgccggcgcgcacgctgtttgaaatgacgcttggcgaaacgttattcctcaacgctaaattgccgaccggcaaagagtttatgccgcgtgaaatcagcctgcttctcgctgaggaaggcagtccgttaagtacgcaggaagtgctggaaggcggcgagtcgcttattttatccgaagtggccgagccgccgtcgcagatgattgattccctcactacgctgtttaaaaccatcaaaccggtgaaacgcgcatttctctgcgcgattaaagaacatgcggacgcccaacctaatctgctgattggcattgaggctgacggcgaaattgaagagatcattcacgcagcgggcaatgtggcgaccgacacgttaccgggtgacgaaccgatcgatatttgtcaggtgaggaagggcgcgcagggtatcagccactttatcaccgagcatatcgcgccgttctacgagcgtcgttggggtgggttcctgcgcgattttaaacagaaccgcatcatctgaagaaaagaaagccgcccaacagggcggcctcctggcttacctgctctggacgttgagcgttacgggaacagaattacctgggtagcttctgtctgcgtgaagacacaacgtgccagaaacaagaagcacgacacaaaagcatcgtaccttcatgttgcggtccttgcgaagaccgcatcacggcagcaccgctggcgataatgccgtgatagcaggcactgtggtgtgcctgcgcttacggccatggaacatcctctcctgaagccagtgcccgtttgcgagacggcgaagggggccgggaaagataatacctcaaatgctgaatagtttcgtcgtgaattaacttgactttgctctccttaaaagggagtatttacctactgtggtgtgcctgcgttgctatggcaacaaagcctgctggaaaggccgcgaaccggaccagcacaaaaaaaccgctcaactgagcggtttttttgtggcctgcttaaacagtatttatgtagattcgttttaaatcagcctgaacggtaggccggataagcgtgagcgccacccgacagcatgtcgattaatcgacgagcgcgtccagttttgcccaaaacgcctcatgataatcctccaggtcaagtaaagcggcatcgcgttgttcattcattttttgctgtgccttccattgcggaagatgtaaatcctcttcggtaaagccaatgtctttagcgcccgaaataatattatagagatattccaccagagaagactccgccagccaaaattcattacgttccatgcgggcaatagggtattcgccgttggcatcccgttctgtgatatagataaaaatggcctgatcgccgacatgatcaatacgaattaatgccggaagacggggatcgttactccagacaggcatcagatcttcaatatcaatacctgagctatccatgccagcgccgtaatacgcctcttcatcaggagagtaagaatgtattactccctcgttatcaataaatctttgtaatgtttcaatcacaggcatattataattgctaagtagatcgcggtcgtaggccagtagcgccttcaggctttcaggtaactcagtggtttccgtattttgcggatcgcgatacttacgcactcgcagacaacttatttcctcggcaggcataggattaggcaccttattgcggttaacctttttaactagctccattaaattagtgagtgaaatatccattttccatccttaaaaaattatatttacaggagttatttcccggtgaaacccaaaacagcggtgatgatactccttatacccgacgtaaagtatttaccgataaaaaataggattttattaagagaaaataatgcccgtttgcaggacagtggaaaagagcggaataaaaacaatgtctgtagatcgttttacatcagcctgaacggtaggccggataagcgtgagcaccatccggcatggcggatattaagcgggttcaaccggtaaatcggtacgcgcgccccattcgctccacgcgccgtcgtaaagcgtgacgtcaggcacatccagcgtggcgagtgccagcaccacgaccgcggccgtcacgccggaaccgcaactggcgataatcggtctgtcgaaactcacgccgtggctgaaaaaaacctcattcagttcgtcagtggtctttaattcgccctcatacaccagttccgtccacgggacgtttagcgcgccaggaatgtgtccgcgtctcagtcccggacgcggttcatcagcctgagcgttaaaacgcgccgccggacgcgcgtcgacgatttgcgcggttttttcatggcttgccagcaatacgtcggtgagacgcaccacggcttgcggcgtgaatttcgcctcaaactcgcctccttcatgcgcttcttcgccttcgcgcaatagccattcgtcgcgctgccagcccgccagtccgcccgccagaatggacactttctcggcaccgaacgtgcgcagcatccaccatgctcgcggagcggagaacagattgccttcatcgtatatgaccaggtgtttatcctggcgaacacccagttcacgcatggccaccgcaaacgcttccgggcgcggcatcatatgcggcagcggcgatgcgcgatcggaaagcgcttcaatatcaaaaaacagcgcgccgggaatatgtccggcgcgatattcgcccgccatatcacgatgttcctgtcctggtggcgccatacgggcgtcaagaatctgtatttccggatcatcaatatgttcggcaagccagtcggcggcgacaaaaaaggcggtggtcatgggcatctccattgttacctgattatggtcaaattgtcggacgtttcccgaaaagggacaagtagaagaggctgttttggctggcgaaaccacatttctgcgtaaaattttcgcgtcatcacagtaatacggacttacacaataaaatttctcgcgcataatatctcatcaaccgttgctgacaggccgttaaggccagggatgaaagatgaaacatttacgcgtggtggcctgcatgatcatgctggcgctggcgggatgcgataacaacgataaaaccgccccgacgactaaaagcgaagcgccagccgtagcgcagccctcgcccgcgcaagacccgtcacagctacaaaagctggcgcagcaaagccagggcaaagcgctcacgctattagacgcctccgaagcgcagctcgacggcgcggcgacgctggtgctgacgttttcaattcctttagatcctgaacaggatttctcccgtgtggttcacgtggttgataagaaaagcggcagcgttgacggcgcatgggagctggcgccaaatttaaaagagctaaggttacgtcatctggaacctgagcgcgtgctggtggtcacggttgatcccgccgttaaagcgctgaataacgccaccttcggcaagtcttatgaaaaaacgattaccacgcgtgatgtccagcccagcgtcggctttgccagccggggatcgctgctaccggggaaaatagcggaaggactgccggtcatggcgcttaacgtcaaccacgttgatgtgaactttttccgcgttaagcccggatcgctggcgtcgtttgtcagccagtgggagtaccgtagttccctctctaactgggaatccgacaatctgctgaaaatggcggatctggtttataccggtcgttttgatcttaatccggcgcgtaatacgcgtgagaaactgctgctgccattaagcgatattaagccgctgcaacaggcgggcgtatatgtggcggtaatgaatcaggctggacactacaactatagtaatgccgctacgttgtttacccttagcgatatcggcgtgtccgcgcaccgttaccatagtcggctggatatctttacgcaaagcctggaaaacggcgcggcgcagtcgggaattgagatcgttcttctgaatgataaagggcagacgctggcgcaggcgacgagcgacgcgcagggacatgtgcaactggaggctgataaagcggcggcgctattactggcgcgtaaagaggggcagaccacgctgctcgatctcacgcttccggctctggatctgtcggagtttaatgtcgctggcgcgcccggctacagcaagcagttctttatgttcggcccacgcgatctctaccgaccgggcgaaacggttatcctcaacggattactgcgcgatagcgacggtaaaacgctgcccgatcaacccgttaagctggaagtggtaaaaccagacggacaagtgatgcgtaccgtcgtcagccagccggaaaacggactataccgtttgaattatccgctggatatcaacgcgccgaccggcttgtggcatgtccgcgccaacaccggcgataatttgctgcggagttgggatttccacgtggaagactttatgccggagcggatggcgctcaacctgacggcgcaaaaaacaccgctggcgcctgcggatgaggtgaaattctccgttgtcggctattacttgtatggcgcccctgctaacggcaataccctgcaagggcaacttttcctgcgtccgctgcgcgacgctgtcgcggcgttgcctggcttccagttcggcaatattgccgaagagaatctttcgcgcagcctggacgaagttcaactgacgttggataaaggcggacgtggtgaagtgagtgctgccagccagtggcaagaagcgcattcgccgttgcaggtaattctacaggccagcctgctggagtctggcggtcgtccggtcactcgtcgcgtagagcaggcgatttggcctgccgatacgttaccgggaattcgtccacagttcgccgccaaagcggtatacgactaccgtacggataccaccgttaatcaaccgattgtcgacgaagacagcaacgccgcattcgatattgtttacgccaacgcgcagggcgagaaaaaagcggtgtccggtttacaggtgcggctcatccgcgagcgtcgcgactattactggaactggtcggaaagcgaaggctggcagtcgcagtttgatcaaaaagatctggtggagggcgagcagacgctggatctgaacgcggatgaaaccggaaaagtcagcttcccggtggaatggggcgcgtaccgtctggaggtcaaagcgccgaatgagacggtcagcagcgttcgtttctgggccggctatagctggcaggataacagcgacggtagcggcgcggcgcgtccggatcgcgtcaccctcaaactggataaagcgaattatcgtccaggcgacaccatgaaattgcatatcgccgcgccggtcgccggtaaaggttatgccatggtggagtccagcgatggtccgctgtggtggcaggcgatcgacgtgccggcgcaggggctggagctcacgattccggtggataaaacctggaatcgccacgatctctatctcagtacgctggtggtgcgtcccggcgataaatctcgttccgcgacgccaaaacgcgccgtggggttactacatctaccgctgggggatgacaaccgccgcctcgatctggcgctggaaagcccggctaaaatgcgcccgaatcagccgctcaccgtcagggtgaaagccagcgttaaacacggcgaaatgccaaaacagatcaacgtgctggtctccgcggtcgatagcggtgtattgaatatcaccgattacgcgacgccggacccgtggcaggcgttcttcggtcaaaaacgctacggtgcggatatctacgatatttacggccaggtcattgaagggcaggggcggctggcggcgttgcgttttggcggcgatggcgacgaccttacgcgcggcggaaaaccgccggtaaaccatgccaatatcatcgcgcagcaggcgcagccgatcacgctcaatgagcagggcgaaggggtcgtaacgctgccgattggcgactttaacggcgaactgcgggttatggcgcaggcatggacagcggacgattttggtcgcggcgaaagcaaagtcgttgtcgccgcgccagtgattgccgagctgaatatgccgcgttttctggcgggaggggatgtttcgcgactggtgctggacgtcaccaatctgaccgaccgcccgcagacgctgaatattgcgctcgccgccagtgggttactggaactgcttagtcaacagccgcaaccggtcaacctggcgccgggcgtgcgcaccaccttattcgttccggtacgcgcgctggaaggttttggcgaaggcgaaatccaggcgaccattagcggtctgaatctgccgggagaaaccctcggcgcgcagcataagcagtggcaaatcggcgtgcgtccggcctggcctgcccaaacggtaaatagcggcattgcgctggcgccgggagagagctggcatgtaccagagcagcatctggcaaacgtctcgccagccacgttacagggacaactgctgttaagcggaaaaccgccgctcaatctggcgcgctacattcgcgagctgaaagcatatccgtacgggtgcctggaacaaaccaccagcgggttattcccggcgctgtataccaatgccgctcaattgcagtcgctcggtattaccggcgatagcgatgaaaaacggcgcgccgcggtggatatcggcatctcccgcatactacagatgcagcgtgataacggcggttttgcgctatgggatgaaaatggggcggaagagccctggctaacggcctacgcgatggatttcctcattcgcgcgggcgagcagggatatagcgtcccgccggaggccattaaccggggcaatgagcgactgctgcgctatctgcaggatcccggtacgatgctgattcgttatagcgataatacccaggccagtacttttgccgctcaggcttacgccgcgctggtactggcgcgtcagcagaaagcgccgctcggcgcgctgcgcgaaatctgggagcgccgtagtcaggcggcttcaggactgccgctgatgcaattgggcatcgcgttaaacacgatgggtgatgccagacgcggcgaagaggccattacgctggctctgaatacgccgcgtcaggacgaacggcaatggatagcggattacggcagttctctgcgcgataacgctctgatgttgtcgttactggaagagaacaacctcagaccggacgcgcaaaacgcgctattaagctcgctttctgagcaggccttcggtcagcgctggctctctacccaggagaacaatgccttgttcctcgccgcgcattcgcgacaggccagcgcgggcgcctggcaggcgcagacctcgttagaggcgcagccgctgtcgggcgacaaggcgctgacccgtaatctggatgctgatcagctggccgcccttgaggtgacgaacaccggtagccagccgctatggctgcgtctggatagcagcggctatccctcatctgcgcctgagcctgccagcaacgttttgcagattgaacgacaaatactggggaccgatggtcagcgcaaatcgctgtcctcgttgcgtagcggcgaactggtgctggtctggttaacggtagtggccgatcgcaatgtgccggatgcgctggtggtggacctgctcccggccgggctggagctggaaaaccagaatctggctgacagcagcgccagcctgccggagagcggtagcgaagtgcaaaatctgcttaatcagatgcagcaggcggatattcagtatatggaattccgcgacgatcggtttgtggctgccgtcgttgtcaatgagggccagcccgtgacgctggtctacctggcgcgcgcggtaacgccggggacgtaccagcttgcgcaaccgcaggtggaatcgatgtacgcgcctcagtggcgggcaaccggcgcgagcgagggactgctgattgtgacgccttaaatgaacggttggcgtggtaaacgtggccgctggctgtggctggcgggcgcgccgctttttattttcctggcgttatgggcagcggataaactctggccgctgccgctcaatgaggtccatcctgcgcgggtcgtggtcgcccatgacggtacgccgctgtggcgctttgccgacgccggggggatctggcgttatccggtgacgattgaagaggtctctccccgttacctggaggccttaatcaattacgaagatcgctggttctggcagcaccctggcgttaaccctttttccgtcgcgcgcgcggcatggcaggatcttaccgccgggcgcgttatttccggcggcagtacgctgactatgcaggtggcgagacttctggacccgcattcgcgcacgttcggcggtaaaatccgccagctttggcgcgccctccagcttgaatggcatttgtccaagcgcgatatcctgacgttgtacctgaaccgcgcgccgttcggcggcacgctacagggtattggcgctgcaagctgggcctacttcggcaagccgcccgcgcgcctgagctacgctgacgcggcgctgctggccgtattgccgcaggcgccgagccggttacgccccgaccgatggcctacgagagccgaagcggcacggaataaagtgctggatcggatggcggagcagggcgtctggcctgccgaaacggtacgcgagtcgcgtgaagagccggtctggctggcgccgcgtcaaatgccgcaactggcgccgctttttgcccgaatgatgttgagtaaaagccggagcgacaaaattgtgaccacgctggacgccgggttgcagcggcaactggaagatctggcgcgggcatggaaagggcggctgcctgcacgcagttcattggcgatgatcgtcgtcgatcataccgatatgagcgtgcgcggctgggtaggatcggtagaccttaatgacgacagccgttttggtcatgtcgacatggtaacggcgatccgatcgccgggatcggtactcaaaccctttgtgtatggtctggcgctggatgacggcttgatccatcccgcatcactattacaggacgttccgcgccgcaccggagattaccgcccgggaaacttcgatagcggatttcacggcccggttagcatgagcgacgcgctggtacgctcgctgaatctgcctgccgttcaggtgcttgaagcctatgggccgaaacgatttgcggcaaaactgcgtaacgtcggcctgccgctatatttgcctgctggcgcggcgcccaatctttcgctgattctgggcggcgcgggcgcgcggcttgacgagatggcggcggcatacagcgcgttcgctcgtcatgggaaagcggcgaaactacggttacagccggacgatccgctgtcggaaagaccattaatgtcgccgggagcggcgtggatcattcgacggattatggcggatgaagcgcaacccttgccggataacgcgctgccgcgcattgtgccgttggcgtggaaaaccggcaccagctacggctatcgcgatgcgtgggctattggcgttaacgcgcgctatatcatcggcatctggacaggcagacccgacggcacgcctgtggtggggcaatttggttttgccagcgcggtgccattgcttaaccaggtcaataatctgttactggcgcatacgggacgcctgccggaagatccgcgtccgcagacggtaagccgcggcgtcatttgctggccgggcggacagactctgcctgccgggaacagcaactgtcgccgccgactggcgacatggctgcttgacgacagccagccgcccacgctgctgttacctgagcaggaagacatcaacggtattcgtttcccggtctggctggatgatacggggcggcgtgtcgctgccgactgtccgcaggcgcgtgcgcatacgtttatcgtctggccgcggccgctggagccgtggctgccgcctgcggaaagacgtagcgcccgcttgcccgcggcgtccgaccactgtccgccgctacagggcaatgatgccgcgccgttaatgctgtcaggagtgagggatggcgcggtgatcaggcaattgccaggccaggaaaacgtcacgctgcccgtctcgactaccggcggcaaagggcgtcgctggtggtttttaaatggcgaacctgttaatggcgaaaataatcgcctttctttattactcaatatcgctggacgttatcaacttgtcgtaatggatgagtccggtcaggttgcagcggttaattttgaattaatacgttaaccattctccaaaatagattatcaattccttttaatttaagcttaatgataattgttaattattactggatcatacataaccggagagcttgataaatatcaagagaaccaacgcataaaaacgtgagaatgggtttttatttgacgagtcggatcatgaaaaatataaaaagccagggaaatggcgaacagcccgctatttctcgccgccattttatccaggccagctccgcgcttattgagttaccgtttgtctcctcgccagctaccgctcaggcgcgcgctgtgacggcaactgaaaacaggcctgcggaaaaagtcgttcagacatgcagcacttttgactgcgggggcaaatgcgatattcgggcgcatgtcagtgacggtatcgtgacgcgaatttcaacgcgaccggataacgcgctggatgcgcaaatgccggtgatgcgtgcctgtgttcgtggacgagcataccgtaaatttgtttatcatcctgacagacttaaatatcccatgaagcgcgtaggaaaacgcggtgaaggaaagttcgagcgaatttcctgggatgaagcgacaaccttaatcgccgataatttaaaatcgattactgaaaaatatggcccggcttcgcgctatgttcatgttggtaccgccgtttccggcggcaccttttccggcgataaaatggcgcgtcgcctgctgaatcttaccggcggctatctcgaaagctaccattcggtgagtatgggcaacacggtggccgcgacgccttatacttacggcattgccgccagcggcagttcgctggatacgcttttggacaccaaactggtgattctgtggggccataacccgacggagaccatttttggtcataccaactatttcttgcagaagatgaagcagaacggtacgcggtttatcgtggttgatccgcgctattccgacaccgtttcgtcgctggcggatcagtggatcccgctgctgcccaccaccgacaatgcgctgatggacgcgatgatgtacgtcatcatcagcgagaatctgtacgatcgtgcatttattgcgcgctacgctatcggttttgacgaagactcaatgccggaaggcgtaccggctaacgaatcgctggtggcatatctgaccggcgccaaagacggtgtcgttaagtctcccgagtgggcggaaaagatcacccatgtgccggcgcaaaccattcgccagttagcgcgtgattacgcgaagaccaaacctgccgcgttgattcaggggcggggccacagcgccacaactgcggcgagcgcaccgcgcgcggctcgactctactggcgaccattaccggtaatgtcggcatcaaaggcggttgggctgcgggttacggcggctgcgctaaccgtaaatttgccgcgggtccggagatgccggataacccggtaaaagccaaaatttcggtgatgaactgggtgcaggccgcagacgacgccagcaaagtgacgccggatatggggctgaaagatgccgataagctggacagtaacatccgtattctgttctcgctggccgggaactatctggcgaatcagaaccccgatctgcaccaggcggtacgcgtactggaggatgaatcaaagatccagtttattgtcgccagcgatctgtttatgacgccgagcgcgaaatacgccgatctactgctgccggaaaccagctttatggaacgttggaacatcggtgaaacttggggcacggcaagctacctgatactctctgaaaaactgatcgagcctgaatttgagcgtcgctccgactacgactggctacgtgaggtggcggcgaaattaggcattgagaatgaatttagccaggggcgcgatgagaaagcgtggattgaacacatctgggaacagacgcgcctggcgatgccggacgaaaatctgccggattttgccacactgcaaaagacccgtcagcatctgttcaaaagcgcgccatttatcgcctttgaagacaatattcgcgatccggacaatcatccgttcccgacgccgtcagggaaaatagaggtcttctcgaagcgcctgtacgacatgcagcatccggaaatcccggcgttgtcgcactacgttcccgcgcatgaaggcccggaggatgcgctggtgaaagattttccgctccagttaattacgtggaaaggaaaaaaccgcgccaactcaacgcaatacgctaacccgtggctgattgaagtgcagcagcagacattgtggatcaacccgcaggatgcgcaaacgcgcggcattacgcatggcgacatggtgcgcattcataactcacgcggaatttgcgaaatcccggcggaagtgacgccgcgcattattcccggcgttgtcgcgatgcaggctggcgcctggtggcagccggatgagaacggtattgataaaggcggctgcgcgaacgtcctcagctcggcccgtattaccgccctggcgaagggaaattcacatcaaaccatgctggtggaggtggcaaaagcatgagccagtttacacattacccgccggtgagcgataaacaactgggatttttcatcgactcctcacgctgctccggttgtaaagcctgccaggtggcctgcaaagacaaaaacaatctggaagtaggccgtcgtttccgccgcgtctatgaagtcaagggcggaagtttcatcccgaccgggcagggcggggtcagcaataacgtatttgcttatacgctttctatttcctgcaaccactgtgcggatcctgtctgcaccaaaaattgcccgactaccgctatgcataaacgcccaggtgacggcattgtgcgcgttgataccgacaaatgcgtcggctgtggctattgcgcctggtcctgcccttatggcgcgccgcagcttaacgagcagaccggccaaatgtccaagtgcgacatgtgcgttgatttactggcgaaaggtgaatcgcccggctgtgtcgcgacctgtccgctggaggccatcaagtttggcccgattgatgaactgcgcgcgaagtacggtagcgtatgcgacgttaacgggctgccagattcatccataaccaaacctaatctggttgtcaaagcgcatcagggcgcagaaaaagagggtaaacgccatgcatgagttaccgctgctgatttttacgctctgtttgcaagggtccgtgggcgtgactctgtggctggcgctgggccgtcagtacgccgtagagggacgcgtacctgcgcgcggcgcgcttcccgcgatggcgggggcgtttgtactggcctgcgtggggctgcttgcttcagcgctgcacatgggctatcccctgaatgcgctaaacgcgttacgtcatgtcgccagttcgtggctgagtcgcgaaatcgtctttgccagcctttatctggcggcgctggggctgggggttgtgctgctgtttttccgaaagcctggctggcagccgctgctggcgctggcggcagcgttcgggctggtggatgtattctgcatggcgcaggtttatatccatgcctcggtggcgacctggcagcatagcaacacgctggcgctgttctttggcacgtcaggcattatcggctcggtagtcattgcgctggcttatctgcgcaacgctggcgccgcaatgcgctgcgctgtggtggtggtcgcactgatggtgctgattcgcctgatcatgcagccgctatggttggcggatattaatgcagtggatacgacggtcgtcactttcccgcatcatccgctacaggcgctggcgcagttgcgcgacatctatcttctcggctggtgtgtctcagcggcgggaatgctctgctttgccgcaggcggtctgcgaaacgccagagggacgctggtggcgggcagcgtattgctgcttatcggcgagattatgctgcgctacgtcttctttagtattggctgatggttaacctgacgatcgatccggcggtagacgtgacgcaggcctgcgtccgtcgtcgctttcgtttttcttcctgccgcgcttgcactgatgtttgtccggcgcaggtgttttcgctggcgcaggggcaggtcagcatagatacgacgcgctgcatagcctgtggcgactgtctgtttgtctgtcctgttgacgccattaccgatatcaaaccggttaaacgctttgtgcagggggatacgttggtggggccgttttcgctacaggcgccaacggtcgatgaactgcttctctggcacagccagtacggtattcgctttattgatattgcggtggagcgatcggcgcagtggctgatggcgttggcggggctaaatttagcgctgcgccgctacggcgagccgggctggtctttcaaacacgttgtcggcgcggaaattaatgcctcgcggcgcactctgtttcatgttccgcgcgacgccattaccccgtgcgccgtcgagccggggaaacggcgtctcagacaggcgttttccgcgttcagcgaatgcgtacccgaaatcagtccgcaagagtgcaggatgtgcggcgcctgctggcgaagctgcccggaaaacgttatccagtttgacgacgacacgctgacgatagcggcggcgcgttgtacgggatgcggcggctgtgcggcggtatgtccgcatcaggcgctgcggctgcggtttgacgtggaacccgcctcaacgcggcatagtgcggtgcatacgctcacctgcgaaagctgcaaacgtactttccatgctctcacgcctgaacacacgcactgcgtgctgtgtcagtcccctgagtttgctgtgcgcctttaacttttgttgctaatgctcattttattttaaaaaaatgttacctgcatccataggcaattgatgggatgctctttataatccgcgcctgacataacaacagaacatatttcagaggtaaacatggctattgaacggactttttccatcattaaacccaacgcggtggcaaaaaacgttattggcagcatctttgcgcgctttgaagctgcagggttcaaaattgttggcactaaaatgctgcacctgaccgttgagcaggcgcgcggcttctatgctgagcacgacggcaagccgttctttgacggtctggtggagttcatgacctctggccctatcgtggtatccgtgctggaaagtgaaaatgcggtacagcgtcatcgcgatctgcttggtgccaccaatccggcgaacgcgttggcggggacgctgcgtgctgattacgctgacagcctgaccgaaaatggcacccacggttcggattcgctggaatccgcgcagcgcgaaatcgcctttttcttcggtgaaggcgaagtgtgcccgcgcacccgttaatctccttcgtctttcacgctgtaaatgcgttggcgataaattatcggttcaaatattatttttgctaatgccgcgtgcagacgtggcatccttacgccagaatttgtacaatgcagcgcccccggacgagcagtaagcttaccggggcgtttcttttttcaaccctccaggggccataacgtgtaataacgaggccggaatagcatatgtctgaacaaattgtcacacctgaaagcagtaccccggtagttcttaacaacgaaacaaaaatcaacctgctggatctaaaccgtcagcagatgcgcgagttttttaaaaacttaggtgaaaaacctttccgcgccgatcaggtgatgaaatggatgtatcactattgctgcgataattttgatgagatgaccgacatcaacaaagtgttgcgcggcaaattaaaagaggtcgcggaaattcgcgcgccggaggtcgttgaagagcagcgttcttcagacggcaccatcaagtgggcgattgctgtcggcgatcagcgcgttgaaacggtctacatcccggaggacgaccgcgctacgctgtgtgtctcttcacaggtagggtgcgcgctggagtgcaaattttgttcaactgcgcagcagggctttaaccgcaacctgcgcgtatcggaaattatcggtcaggtctggcgtgcggcgaaaatcgtcggcgcggccaaagtcaccggccagcgtccgatcaccaacgtagtcatgatgggaatgggcgagccattgcttaacctgaccaatgtcgtaccggcgatggaaattatgctcgatgactttggtttcggcctgtccaaacgtcgtgtcacgctctcaacgtccggcgtggtgcctgcgctggataaactgggcgatatgatagacgtcgcgctggctatctccttacatgcgccgaatgacactattcgcgacgaaatcgtcccgatcaacaaaaaatataatatcgaaacgttcctgggcgcggttcgccgctatctggagaaatccaacgccaatcaggggcgcgtgacgattgaatacgtgatgcttgaccacgttaacgacggcactgaacacgcgcatcaactggcggagctactaaaagagacgccttgtaagattaatctgattccgtggaacccgttccctggcgcgccgtatggccgcagctctaacagccgtatcgatcgcttttctaaagttttgatgagttatggtttcacgaccatcgtacgcaagacgcgtggcgatgacattgatgcggcatgcggacagttggcaggcgatgtgattgaccggactaaacgtactctgcgtaagcgtatgcagggagaggtgattgacatcaaggctatttgatagcagttgcgccacggggcattcattataccgtggcgcaatgtcagttgaataatgtctggcgttgtacttgtctggtcaataataacggtgcgtttttgtcgactttaaggcagtatgtaacgatgcaacaagagtttaaccttgtgtcttaagcggttttgtcatctgcggcctgacaggcttatactgtctgactaaaggttaactaacctgatgtttcgcggtgtgggcgggcattacggctcgtcggcgcctgaatcctaatttacacgtacctgtagctgtagcgaatgaatactgaagccacgcacgaccaaaatgaagcacaaaccaccggcgttcgtctgcgcaatgcccgtgaacaactcggactcagccagcaggctgtcgctgagcgactttgcctgaaggtttctacggtacgcgatattgaagaagataaggcgccgtccgatcttgcttcaaccttcctgcgcggatatatccgctcatatgcgcgtctggtgcatgttccagaagaggaactgctgccggggctggaaaaacaagctccgctgcgcgccgctaaagtcgccccgatgcagagtttctcattaggaaagcgtcgtaaaaaacgcgacggctggttaatgtcttttacctggctggtactgtttgtggtcgtagggctgaccggcgcctggtggtggcagaaccacaaggcgcagcaggaagagatcacgacaatggccgatcaaagcacggctgaactgaacgcagataaagacagcggccaaagcgtaccgctggacaccagtgccgcgacaagccaggatacgacgccagcgcaaacggctccggctcctgcgacgccggttgattcgacggcggcaacgcaaaatacggtagtcgcgccttcgcaggcgaatgtcgatacggctgcgacatctgccgcgccagcggcaacggaaacgccgtccgcgctgccgaccagtcaggctggcgtagcggcgcctgctgccgatccgaacgcgctggtgatgaattttaccgctgactgttggctcgaagtcactgacgccacgggtaaaaaactgtttagcggtatgcagcgtaaagatggcaatttaaacctaaccggtcaggcgccttataaacttaaaattggcgcgccggccgcggtgcagatccagtatcaaggaaaacctgtcgatctgagccgctttatcagaactaatcaggttgcgcgtctgacccttaatgccgaaccgacaccggcgcagtaacagacgggtaacgcgggagatttttcatgcataaccaggctccgattcaacgtagaaaatcgacacgtatttacgttgggaatgtgccgattggcgatggcgcccctatcgccgtccagtcgatgactaacacgcgtaccactgacgtggaagcgacggttaatcagatcaaagcgctggagcgcgttggcgcagatattgttcgtgtttctgtaccgaccatggacgccgccgaagcgttcaagcttatcaaacagcaggttagcgtcccgctggttgccgatattcacttcgactaccgcattgcgctgaaagtagcggaatacggcgttgactgcttgcgtattaaccccggcaatatcggtaacgaagaacgcattcgcatggtggtggactgcgcgcgcgacaaaaacatccctatccgtatcggcgtaaatgccggatcgctggaaaaagatctgcaggaaaaatacggagagccgacgccgcaggcgctgctggaatcagccatgcgccatgtcgatcatctcgatcgtctcaactttgatcagttcaaagtgagcgtaaaagcgtccgatgtattccttgccgttgagtcttatcgtttgttggctaaacagatcgatcagccgctgcatctggggatcaccgaagcgggcggcgcgcgtagcggggcggttaagtcggcgatcggtttaggtctgctgttatcggaaggcatcggcgacacgctgcgcgtatcgttggcggccgacccggtggaagagatcaaagtcggtttcgatatcctgaagtcgctgcgtattcgcgcgcgcggcatcaatttcatcgcctgcccgacctgttctcgtcaggagttcgacgttatcggcacggtgaacgcgctggagcagcgtctggaagatatcatcaccccgatggacgtctcgatcatcggttgtgtggtgaacgggccgggcgaagcgctggtatcgacgctgggcgtgacgggcggcaataagaaaagcggcctgtatgaagacggcgtgcgtaaggacagactcgataacgacgatatgatcgcgcagcttgaatcccgtattcgcgcgaaagtaagtcaacttgatgaagcgcgtcggattgacgtgctgcaggttgaaaaataagaacgtgatgggaagcggcgcgcttcccgtgtatgattgaacccgcatggctcccggttcgttcggggaagcgctgagggttcatttttatattcagaaagagaataaacgtggcaaaaaacattcaagccattcgcggcatgaacgattatctgcctggcgaaaccgccatctggcagcgcattgaaggcacactcaaaaacgtgctcggcagctacggttacagtgaaatccgcttgccgattgtagagcagaccccgttattcaaacgcgcgatcggtgaagttactgacgtggttgaaaaagagatgtacacctttgaggatcgcaacggcgatagcctgacattgcgccctgaaggtacggcgggctgtgtacgcgccggcatcgaacatggtctcctgtacaatcaggaacagcgtttgtggtatatcgggccgatgttccgtcatgagcgtccgcaaaaaggccgctaccgtcagttccatcagctaggcgccgaagtctttggcttacaaggcccggatatcgacgcggaactgattatgctgaccgcacgctggtggcgcgcgctgggcatctctgaacacgttagcctggagctgaactctattggttccttagaggcgcgtgcgaactatcgcgatgcgctggtcgcgttcctcgaacagcatcaagagacgctggacgaagactgcaaacgccgtatgtataccaatccgctacgcgtgctggattcaaaaaatccggacgtgcaggcgctgctcaacgacgcgcctgttctcggcgactatctcgatgacgattcacgcgagcactttgccggcctgtgtaaattgctggacgcggcggggattgcctacaccgtcaaccagcgtctggtacgcggtctggattactacaaccgcaccgtatttgaatgggtaacaaacagtctggggtcacaaggcaccgtctgtgcgggtggtcgttatgatggtctggtggaacaactgggcggtcgcgctaccccggcagtgggctttgcgatgggcctggaacgacttgttttgttagttcaggcagttaatccggaatttattgcctctcctgttgtcgatatatacctggtagctgccggcgcacaaacgcagtctgcggcaatgacgctggcggagcggctgcgcgatgaaatgccaggcgtgaagctaatgacaaaccacggcggcggcaactttaagaaacagtttgcccgcgccgataagtggggcgcccgtattgcactggttcttggcgaatctgaagtcgccgatgggactgttgtagtgaaggatttgcgctccggtgagcaaacggcagtggcgcaggacagcgtcgccgcgcatttgcgcactttattgggctaaggagaaggacagcgtggaaatttacgagaacgaacacgaccaggtggatgcgattaaacgcttctttgccgaaaacggcaaagcgctggctgtcggagtgattttaggggttggcgcgctggttggctggcgttactggagcagccatcagacggagtccgcgcgtgctgcttctctggcgtatcaaaatgcggtgacggcggtaagcgccgataagccggatagcattcccgccgctgaaaaattcgcggctgagaataaaaatacctatggtgcgctggcgtctatggaactggcgcagcagtttgtggataagaatgaacttaaaaaagccgaagcccagttgcagcaggggttggcggccaccagcgatgaaaatctcaaagcggtgattaatctgcgtctcgctcgcgttcagttacagcttaagcaagctgacgccgcgctgaaaactctggatgccgttaaaggcgaaggatggacggcaattgtcgctgatttgcgcggcgaagcgttgctgagtaagggtgataaaaaaggcgcgcgcagcgcatgggaagcgggcgtcaatagcgatgcttctccggcgttgagcgaaatgatgcagatgaaaatcaataatttgtccatctgagagggacccgatgcaattgcgtaaattacttctgccagggttgctttccgttaccctgctcagcggctgttcactgtttagcggcgaagaagatgtcgtcaagatgtctccattaccgcaggttgaaaaccagtttaccccgaccactgtctggagcacctctgtcggtaacggaattggtgaattttattctaaccttcatccggtaatggcagataacgtggtctatgcagccgatcgcgcgggcgtggtaaaagcgctcaatgcggatgatggcaaagagatctggtctgtgaatctgggcgagaaagacggctggttctctcgttcgtccgcgctgttgtccggcggcgtcactgtcgcgggcggtcacgtctatatcggcagtgaaaaggccgaggtttatgcgctgaataccagcgacggtaccacagcatggcagacgaaggtcgcaggcgaagcgttgtctcgcccggttgtcagtgatggaatcgtccttatccataccagcaacggtcagttgcaggcgctaaatcaggcggatggcgccattaaatggacggtgaacctggatatgccttcgctgtcgctgcgcggcgaatctgcgccggcaaccgcgttcggcgcggctatcgttggtggtgataatggccgcgtcagcgccgtgttgatgcaacaagggcagatgatttggcagcagcgtatctcccaggccactggcccaacggaaattgaccgtctgagcgacgtcgataccacgccggttgtggtaaacggcgtcgtttacgcgttggcgtataatggtaacttaacggcgctggatctgcgcagtggtcagattatgtggaaacgcgagctggggtcggtcaatgactttatcgtcgacggcgaccgtatctacctggtcgatcagaacgatcgtgtgctggcgctgaccactgacggcggcgtaacgctgtggacgcaaagcgatctgctgcaccgtttgctgacctccccggtactgtataatggtgatttagtcgtcggcgatagcgaaggttatctgcactggattaatgtcgatgacgggcgttttgtggcccaacaaaaagtagacagttccggttttctgaccgaaccgacggtggcggatggtaaactgctcatccaggccaaagacggtacggtctacgcgattacgcgttaatcgtcacggttgtgcgtttgaaaaaacggctcctggtgtaggggccgttttcctgtttttaacaacggcgtaaaaatgacgcgcgttgtctgatgattttttaaatgaggctttaaacatggtacctgtggtcgcgcttgtcgggcgccctaacgtcggaaaatccacgctatttaaccgtctgacccgcacccgagatgcgttggttgcggatttcccgggtctgactcgtgaccgtaagtacggtcgtgcggaggttgaaggccgcgagtttatctgtatcgacaccggcggtattgacggcaccgaagacggcgtcgaaacgcggatggcggaacagtcgctgctggcgattgaagaagcggatgtggtgttattcatggtagatgcgcgcgctggtctgatgccggcggatgaagcgattgccaaacatctgcgctcccgtgaaaaaccgaccttcctggtggcgaataaaacggatggtctcgatcccgatcaggcggttgtcgatttttactcgctgggattaggcgaaatttatcctatcgccgcctcacatggtcgcggcgtattgagcctgctggaacatgtgcttctgccgtggatggatgatgtcgcaccgcaggaagaagtggatgaagacgcggaatactgggcgcagttcgaggcggaacaaaatggcgaagaagcgccggaagatgattttgacccgcaaagcctgccgataaagctagcgattgtcggtcgcccgaacgtaggtaagtccacactcactaaccgtattctcggcgaagagcgcgtggtggtatacgacatgccgggcaccactcgcgacagtatttatatcccgatggaacgcgacgaacgggaatatgtgctgattgacacggcgggggtgcgtaagcgcggaaaaatcaccgatgcggtagaaaagttctcggtgattaaaacgttacaggcgattgaagacgctaacgtcgtactgttggttatcgatgcgcgcgaggggatctctgaccaggatttgtctctgctgggctttatcctcaatagtgggcgctcactcgttatcgtagtcaacaaatgggatggcctgagccaggaagtcaaagagcaggtgaaagagacgctggatttccgtctgggctttattgattttgcccgcgtgcactttatctctgcgctgcacggcagcggtgtcgggaacctgtttgagtccgtacgcgaggcttacgacagttccactcgccgggtgagcactgcgatgctgacccgtatcatgacgatggcggtggaagatcatcagccgccgctagtgcgcggtcgccgtgtgaagctgaaatatgcccacactggcggctataacccgccgattgtggttattcacggcaaccaggtaaaagatctgccagactcctataagcgctatctgatgaactacttccgcaagtcgttggaagtgatgggtacgccgattcgcattcagtttaaagaaggggagaacccgtatgcgaacaagcgtaacacactgacgccaacgcaaatgcgcaaacgtaagcgtctgatgaagcatatcaagaaaagcaagtaatgctttttcagtaatattccaggcctgataagcgcagcgctatcaggcctttcaagtaaaagcgagtcacgcgcctgaggagaatgttatggaaataatctgccctgtttgccatcatgcgctggagcgcaatggcgatacagcccattgcgagacatgcgctaaggatttctcgttacaggcactttgtcctgactgccgccagccgttacaggttttgaaagcctgcggcgcagtggactatttttgccagaacggtcatggtttaatttcaaaaaaacgggttaatttcgtcatttccgatcaataaaaccactgtcgacgttgcgtcgcagagcagaggcgccgacgtcttatccggctaagggcaaaagcgttattctatactcccgtaatatcagcatagtaccctgcccggcggttattttattctttttatcgattcaactatttatagggaatattattcccgaaaattaatattagaaataaataacagctttccttttatttattatatcaatattataagtctgtttcatattaaacttttctttttaggaatatatttaggcctgttagttatgattccctatgaatcatccatataatatcgtctcatagcagcgtgtttatttaacaacagggatatcatatggtgcgaaggattcgcattctggttttgctattagtgtctggagtatcagttgcggcttccggcgcaggtaactctgtacctgcaaacgatgaaagccactcctccctgcctgatttagccagcgaatccgcgaaaaaagaagaacaggaaaataaaggaaagtcctttaaagaacagggcgctgactactttattaattccgccacccagggctttgataatctcaccccggaagcgctggaatcctaggcgcgtagctatttgcaaaaccaaatcacttcatcagcacagtcatatcttgaaggcgtaatgtcaccttatggcaagatccgtaccagcctctccgtaggcgaaggcggcgatctggacggcagttcgctggattatttcgttccctggtatgataacgaaaaaaccttactttttagccaactctcagcccaacgtaaagaagaccgcactattggtaactttgggcttggcgtgcgccagaacgtcggcaactggctgcttggcggcaacgcattctatgactacgattttacgcgcggtcaccgtcgactaggtctgggaaccgaagcctggacggattacctgaaattctccggcaactattaccatcctctttctgactggaaggattccgaagatttcgacttttatgaagaacgacccgcgcgcggttgggatatccgcatggaaagctggctgcccttttatccgcagcttggcgctaaattagtttacgaacagtactacggcgatgaagtggcgctgtttggcaccgataatctgcaaaaagatcctcatgccgttaccttggggctggaatatacgccggtaccgctggttacggttggttcggattacaaagccggtactggcgataataacgattttagcgttaaagcgactgtgaactaccagataggaacgccgctggcggcgcaactcgatccggaaaacgttaaaatccagcactctttaatgggcagccgcaccgattttgtcgatcgtaacaatttcatcattctcgaataccgcgagaaagatccgctggacgtcacgttgtggctgaaggccgacgccaccaacgaacacccggaatgcgtgattgaagatacgcctgaggccgcggtggggctggagaaatgtaagtggacggtcaacgcgctgattaaccatcattacaaaattatttctgcttcctggcaggcgaaaaacaacgccgcccgtactctggtgatgccggtggtaaaagcggatgcgctgaccgaaggcaacaataacagctggaatctggtgcttcctgcctgggttaacgccgataccgaggcgcagcgcaccgccctgaacacctggaaagtacgcatgacgctggaagacgaaaagggcaataagcagaactccggcgtggtggaaatcaccgtccagcaggatcgcaaaattgagctgatcgtcgacaacattgccgataacgatcgcagcgatcacagccatgaagccagcgcgctggccgatggcgaagacggcgtggtgatggatctcctgatcaccgactcctttggcgactccacggatcgcaatggtaacgaactggtggacgatgctatgacgcccgtgttgtacgacagcaatgataaaaaagtcacgctggcccagacgccctgcaccacggaaaccccctgcgtgtttattgccagccgtgacaaagaagcggggacggtgacgctttccagcaccctgccgggcactttccgctggaaggcgaaagaagacgcctatggcgacagtaactacgttgatgtcacttttatcggcgacaacctgagcgcgctgaatgcggtgatttatcaggtcaaagccgccaaccctgtcaacctgatcggcaaagaagataaacatcctacggttaataacacctaccgtttcctgctgtggcgcgacaagaataaagacggcgtattccagatgtccgagcagctcacggaagaagagatggccctgtacgactaccagtgggagtttaccggacagagtacaaacggacataccggcgcgctggccaacaccataaatgaagatcttgttctgccagtaaccaataaagaggcggcgcagaagtttgccgccaatgtggaagatggcgttcagggttacggtatacgcgttacgtatagtcagaaatagcgtcagcgttatggctgaccagccagccgctgaattttgagaaaaaagagagtctgaatgcaagcaacagtaaaacggcggctgacgaaggtcgctttagcattagtagttgccgggtattgcgccgcgccagcggtggcggcaaacggtaatctgaaatcggggcagtggcagattgtctctgaacagacgggcaccattcagggtacggtgccgtggattacccgtgcggcggataagaccgcggataccgacaaagatcacgtaacggtaactatcgatcgcggcgatcgtaaaattgtgaccgaaggcgataagcagttccacgttggcgataaggtcacggtcaactgggcgattggcgatacggaaggcgacctggatgtcgacaacgccgccacgaaactgacggtgcagtggatgagatacagcgaccagaatggtagcaatcccgaagagattggcgccaaaggcagcgatacctatgaaattcaggcgggtgacgcagaccattatatcggtatcaaaatcacgccaaccaccaccaccggtgaccctgccgtggcaaccgaactgctgttgaaagacctgtcgaccgatgcgggcggtggtgcggatggcgacgacattccggaaggtccggtggtggatgaaaacgtccatgtggttattcatgagaaagattcgaataccaacctgttgaagaattcagggacgacactcaaaacgaatactacctatcaggtattgctgtggagcgataagaacggcaacggcacctatgatgccggtgaaaacgttaccgaccagtatgactaccgctggaaattcgtcggcaccagtaaaattgcaggtaccggtactggtggtatcgtcaacgaaaactggaacgataaagaccttgtcatcccgcttaccaacgccgaagcgaaagaggcgttcgagggtgcggaaggcggcgttaccgtgggtagcgacggtgtccagggctttggtctgtccatcgactacaaacgcaaataagttgtcctcaacataccactccccgcggggagtggtattttccgcgcactttgcttagccgcgcgctaagcaaagtgggttgaattacgacagagaatgaaaacgggtggctatcgctcatggacaggaatcggcaagtgaataaagttgtacatttcttactgacattactgatcatgtttgtagcgtcgatcgcgcctgcgcaggccttactgaaaggcgggacctggcaagaattgaactcagccactgccgcagttaacggcaccgtgccccgcgccgacggcgcgattattcccgtgtatcagggaagtatgctgcttgacccgaccaaaacctacgatgttgcgtttaccgccatgccgcgcgattttagcgcggatgccacctcaacctcgatgcgtgcggtcaattccaccgataccgaaggcgatctctttagcgatccgccgaccattgcctgggaaaatcaacagccgccgagcgtgggcctgttatgggccgatgccgccacgcccgacacgccgctttcgccgcagccgacgcctaaccagaccttttgcgcccagaacctggccggacggaaactggttgtctggccgcagccagacgatgaaacgaccgtccccgcgctgtggctctatactcacaccggcgtgccgaataatgcggccatcccgctgctcagcccgaaagtgactgtcaatattgcccaggcagtaggcaatcccgtgtcggtcagcggcgatcatgttgatgccagctttaaagcctcaaaagtgaaagtaggagagagcatcaccctcaccgtcacgaccagagggtgtgatggcaaactggtgaaaaatgcgccgtttgtcatccgccgtgaggatgccaaaaaccgtcagggtgtggtcaataacactaacccggtgcacgttggcgatgccgagctaacgaccgtgcaaacggagtatcgcggcgtcaccgatgccgagggtaaagccactgtggtggtgacgcaggatgaaggccccggcgtaaaaacgcatcttatcgtcgcttcgcaaagttatcctacgctgacggacggcgtggacgttattttcaccaccatcaccagccccgacaccgcccaggccaacatgtacggccacatgctggagagcgccagcgccacgctgaacggcgcgacctacactttcactcgaccgaagctggcggtggaggcgggtaacgctgacgaaagcgtcaacgatactaacgaaacctgggcgcagtttacctggagcggcgcggataaccattgcgacgttctgccggacgccgaacaactggtggcgctaagacatgcgcatagtacgctggcaacgtacaccggctggccggcgtcgggcgatgcggaatactggtcgtcaaccaaagatcagatgaacaactaccacgctgccgtgcatatgaacagcgcgtcggtcgtcagagcgcccaacagcgatacgctgctggttagctgtgtggataaagcccagcctgcggcgcacccgcagattaccctctctccggaggggccttataaggcgcaggtgggggaatcgattgatctggtcatgacggtagtcgataaagacacgcaaaaaccgctgccttaccgttacatggagctgtttatcgacccggcgaaaaaccgcaaaggggagcatcaggacgcgtgggataaccagcgggttaccgtcagctccgaagatatgcgcgcctcttcgccggaacactataccggcgtgaccgacgtcaacggtcaggcgcacctgacgctacagcacgacagcggcatggggggcgagacgcccatccgcatcgtgatgccggacgatgaaggcggcaacgtcgagctgccctttagcgtcattttcaccgtaataaccagcccggatgtggacggcgccaacatgtggggccatatgcgcggcgtggtggatgccggcaacctgtataaacgcccgctgctggcggtggaagccagccataaagacggtcagttcagcgaaaacaacgaagagtgggcgacgtttaactccgtggcgtcggccaccgcgcagtgcggcgtcggccaggtgccggatcagtcatcgctggcgcatttatacagcgagcaccccagcggcaagatggaaatcgaacacggctggccgaccgaagactacttcatcgccgcggatagcgacgcctcgggaacggtacacgtcaacctggcaaacggcgacagcaacaaatttaccaatcagccgaactacctgacctgctcggccaatgaaatggtggcggtgctggacgtctacttcaacgacgacccaacgactaaaaatgctgatatgaccgccaaagtcggcgaacagattaagctgaatattcattcgcgcaacgcccttaacgacatggcgattgcctataccgacttcaccatcaccatggcgaacggcaagcggcgcgacggattgacgaccggctttaccgatcccagcaacggcgagatgcagtttgacggcgtgggctaccttgccgggcaggtttatcacgggatcaccgacgccaacggcgatgcgaccattatcctcacccagaataagggcgtggggctactgacgccgttaagcatcgcgcccgtcgattcattaatcaagacgccgatttcccgcagcgtcaagtttaccgtcgccaccagcccggacacggtaaaagccaaaatgtggggccacatggccgacactcttaccgtcggcgactggacttttgagcggcctaagcttgcgagtgaagtaaatagcccgctgcgtactcaggaagagagcaatgaaacctggacgcgcgtggcccatatcgacgcggcgggcaacccggatgcgggcggctgcgcggcgaaccgcctgccgcgtatcgaccagcttgaggcgttatacagcgccaacagcggcggcgcgatgaaaaagactcagggctggccaaccttaattaactactggtcgtccacctaccagagcgccaccacctggaaactgatcgcgctggcgagcggcagtgaatttccgggcagcaacacctcggtttacaccagttgtctggccagcgataacccggtgccagccgccatcaccattgaaccggtcgatccgtcgcagtggtacgacggcagtggcgtccatgcgctgaaagtgaaaaagggcgataccctacagttgaaggtgacggtgaaggacgccagcggcaaaccggtgccggaagcgccgtttgtgctcacccgcggcgacggctacgatcgcaaaggggaaaagtacaccgcccaggacggctccgatttgcaaaatatcgtgacgcccgtggtgatcgacggcgaatcgctggcctggactaccaccaaaatggggtcgcagaccggccctgatggcacccgcatcatcagcgtcacccgcccggacacccacggcacccgcacggccattaccgccacgctgtatgaaaatgtcgccgtgagcgccagcatcgacaccatctttaccgtcgtcaccagcccggatgtcagcgtcgcccgcatgtgggggcatatgacgccgtcgctgacggctgcggatagcgcggtgtacaagcgcccgctgctctacgatgaactggccagcaagaccggtgctgcggagtacccggaagacaacgaacgctgggtggtgttctatgggccgaatacgaccaaaaccgttagtccggaagcttgctccaaggggtatttcccgtccgttgagcaactggattctctgtacagcaaatacccgaacggagcgataaaaaccgcccagggctggccgatcatccgttcttactggagcggcacaaacgccgggacaatcacccccggcgcgccaccctatgactattacacggtcgatctgaatgatgatgcgcaccggaaggttcccaatattagtgatagcgacaggcaataccagatttgcgccgcgacgccgcagcctctggccgggcggattaccctcacttctacgctggcgacggatagcgatatccaggcggtgaaggcaaaaaacagcgactcgattccgctggtgatcaccaccaccgatgcggcgggcaacccggtgccttatacgccattttccctcatacgcgacgccgggacggcgcgcaacaccagctatacctttaccggcagcactaacatgatgctggcgccgcccaccggttcggcgcaacagttctactataatggctacactatttacggtgccaccggcgcggacggcacggcggtcctcacgctgacgcaggccgcagggccgggggtgaaaaacgtgataaccgcagccctgaccgacacgccgacggtaacctcgacgctgccggtggtgttcaccaccgtgaccagcccggacagcccgcaggccaatatgtatggccatatgccggaaaccttcaccgccagcaacggcgcggagtttaagcgcccgctgctgtatagcgagctggcgtcgacgttaggtgtgaagagctatgccgacacaaatgaaaactggcctatagtgaataattttgataccagtaattatggcgcctgttcgataaatcagatggccacgctggatgatctcaaggcgctgtacggcgatcaccccagcggcaaggtcacgaccgacataggcttacccgtcaggaagaaatggtgggcgggcgacagcctgctgcaaggtcaagtcatatactggcgatatatcgatctcagtacgggcatagattactccatgtcgggaacgccgggtaattactattaccagctctgcctgaccaaaccgcgccagatgaatatcgcgctctctacggacgcctggaacgcggacaaatcggcggccgtggcgaaaaaaggcgaaacgatccccatgacggtgaaggtgacgaacgctgccgggcagcctgttagcaacgcgacggtgaaaatcacgcgcggcgatgcgctgacgcgtgcggggagcgtgtataccaccaacaacgcggacgatattaccttaagtaatatccagccttccggtacggcgacgtacttgctggggtcggtggataaatatatgtatgcgcaaacggacgcccaggggcaaataacgtttagcgtgtcgcaaaataatactatgggtcttaaaacgcccatccgcgtcaccgttgcgaatgacattaccgcaacgagcagtaaggacgtgatatttaccgtccttaccagcccggacgtcgccagcgccaactactgggggcatatgccggaaaccgtggaagggccggacggcctccgctaccagcgcccgcatttgcaggcggaagcgccgtcgggcgtcaactacatcaccgtgaacggtgaaaaatgggcggcgccgaccggcgtacagacgtatacggcaggccagtctgcgtgcgacgttgagtatatgccgctgatgaatgacttaaaggcgctacagcaactgtatcctgacggcgcgctggaggatcaattcggctggccggtgaaaaccggtaaactctggtggtctgccgatctgaatagctcgaaagcacaccaggcgataaacctgaaaaccggtcagatatcggcgccaacctccaccagcttgcaggcctgtttggtcaatgcgcgtaatgtccctgcctccattacgctaacctcgacggcgatggatgcggagaaaggcgcggcggtggcgaaaaaaggcgaggctattcccttgacggtgacggtgaaaaaccgcgcgggcgttcccatagcgaatgaaccgtttaccctgaaacggggcgatgcgaatgatcgcctcgacattaaatatacgtggaatactacagcagacgatttgacgttgcaggaactgacgccgtcgccgacaacgaaatcaatgacggcttccggcaatgtgtttagcggcgtcacgggggctgacgggacggcaacgtttacggtgaaccaggacggcagtgtggggctaaaaaccgagctgacggccagcgcgacgggggatgtcacgcaatcaaccaacacagcgctgggcgtgatctttaacgtgattaccagcccggataccgataaagcgcagtactgggggcatatgccggatacgctgacggttggtggcgtgacgctgcatcgccccttgttgatgaaagaagcgcctgctggcgcgacggatagccggaaagaaaataacgaaacctgggtttcggtttatacgaaagccgatggtcttacctatgatatgagcaagaactgtggcggggtggccgggttcccggcaaaaggcgtgctggaaaaaatacgcgatgagcagatggcggtcgctaacggatggccgacagtttcgttgccttacgctagcagtacgcctgggacgtataattattgctgggtttcgttagcgaaagggggcacaacacattgcccgaccaccagcagcgattactcgataggctatgccgcctgtcttgtacagccgtgatcgggatggttgggtttcggtaaattgtcgttggtaccggtagtgaaacgtttcgcatttttaccgccgatggaatgaatagtcagaaagggatgtattccaggtgctgcattgaaactgaaaacgaatacccatcttttatccgggctacaggcatgtctgttttgtgttaccgctttttttgcccaggcggcgcaaagcagcgccccatggcaggagcctgacgtctcaactgccgccattaacggcacgccgccgctggctgacggcgtgacgatcccggtttatcagggcagcgttcagttgcgatctgatgcagcgaatcccgtcgattattccgcgaaacccagccagttcagcaccagtgatgtcggcagcgcgctgaccttaaccaatccgcgcgatgccgaaggcgatattttcgccgagccgccgctggtctggcagagtgaacggataccctccgtcacgctggtatgggccgacgccgccacgccggagacgccgctgtctccacaatcgtcggcaaacctgacgttctgtgagcaaaatatggcaggccgccatctggtagtctggtcgcaactggatacctcaaccgctatgccgccgctgtggttgcttacccgcaccggcgtgccttataacacggcggtcgaagtgcttgaacaaaagtttgccgtggatatcgcgcccgccgtgggtgacccggtaacccttaccgccgatcatctggatgagtcgcttaacgccgcgaaggtgaaagcgggcgaaagcatcacgctgacggtgaataccaaaggttgtaacggtgagccagcgggcaatatcgcgtttgtgattacccgcggcgatgcgcaaaaccgccagggcgtggtgaacaataccgcgccggtacgcgtcggcaacaccgaactcaccaccactgccaccgaataccacggcacgaccaacgcggaaggggtggcgacggtgaccgtcacccaggctaacgggccgggcgttaaaaccccgctgatggcgcacccgtcgaacgcgcctgcgctgaaagccagcgcggatgtgatttttaccaccctcaccagcccggacagcagcagcgccaacatgtacggccatatggcggacagttccaccgccacggtggacggcgcaagctacacttttgaccgccccaaactggcggcggaaaccgagggcgaagaccgcgtcgccagtatcaataatgaaaactgggcgcagttcacctggggccatgcggataaacactgcgatattctgccggatgcgcgccaactggaagggttaaaaatcgagcgcggcgatttagccaccactctcggctggccggtggggtgacatccggtgacgaagagcactggtcctcctcacagggggcgagcgcaactgaccacatcagcattgatatgcgcagccgcgcccttacgcagatgccggacgccacgcaatcgctggtgagctgtgtggataaagcctcgcctgcggtcacgccgaaattagtgattagcaccgataattttgattcgacggccaacgcggcgaaagtgaaggtgggcgaagagatcaacatgaagatcgccgtcaccgacagcgccaccaataaaccgctgccttatcgctactttaatgtctacctgggcgacgagcaaaatcgccagaatcagaagaacgccgatcttgatgccgcgcatcagtggacggatgaaccggtagttatcgccaatctggacggcggcgacggtcactatcacggcgtcaccgacgccaacggccagttttcgctggcgctgacccaggacaagggcgctggcgtattaaccccggtgcgcgtggtgctgttcgacggcacggaagcgacgcagaatgtgatttttaccgtcgtcaccagcccggacgtgacgcaggcccgtatgtggggccatatgcagggcgtggtggaagcgggcaatatttacaaacgtccgctgctggcggaagaggccgcgcaggataccggttccgaatttgagaataacgagtactgggccacgtttaactcagtgacggcagcgacaaaccagtgcggcgcaggccaggtgccgggacaactgctgctggatacgctgtatgaagcccattccggcaatacgatggaaacgacttacggctggccgacacagaaacatagctatattgcggcggataccgatggttccaccactgcgcacgttaacctggcgaccggcgcggacagcctgttcagcggcgctgaaccgaactatctctcctgctccggtaacgagttggtgaccagcctggacgtgtactttgatggcaacgagtcgttacgtaatgcggtagccaaagtgggcgaaaaaattacgatgaacgtccattccgtcaacgcgctgaacgggttaagcgtgcccaacgccagctttaccgtcaccatgtcgcacggtaaaaatcgcgccaacgccaccacgggctttaccgatcccagcgacggaacgctggtgatgggcggaacgtctttcggctcttccctggcgtcgatgacgtaccagggcatgaccgatgccgcaggcaacgccacgctggtcattgaacaaccgcagggtgtcggcttgctgacgccgctgaccgtactgccggttaactcgctgatcaccacccccgttaaccgcagcgtgaagtttaccgttcccaccagccccgatacgccggatgcgcaaatgtggggccatatgtccgacgccatcacggtgggcgatatgacctttgagcgaccgaaactggcggcggaggttgccgcgacccgcacccaaaccgaggccaacgagagctgggcgcgcgctacccatgccgatgcggtaggcaatacggcggcgggcggctgcgccgctaaccgattgccgcgcgccgatcaactggaggcgctttacgccgctaaccgcgacggggctatcaatagcacgcacggctggccggtgctgattaattactggacctccacctggcaaagcgccacaacgtggaaactgatagcgctttctaacggtagcgaatttccgggcggcgctggcgcatccgattacgtcagttgccttgccagcgataacccgacggcagcctccatcaccattgagccggtgaatacgtcattgtggtatgacgagaacagcgaacacgcggtgaaggtgaaaaagggagatacgctccagcttaaagtgacggtaaaagacgccagcggcaatccgctgccgcaagcgccgttcgtgctcagccgcggcgacggcatcgtctcggcggtagtgattgacggcgattcgctcaacgacaccgccaccaaaatcggcggcatgaccggtgaaaacggcagcaaaatcatcaacgtcacccgcccggatgcccacgggacgaaagtcgcgattacggcggcgctgtacgataacgccagcgcgacggccagcatcgacactatttttactgtggtcaccagccctaatagcgacaaagccaaaatgtggggccatatgccggaaacgaccacggcggccaacggcgtggtgtttaagcgcccgctgttatcggctgaaatcgccagcggctttacccacggcgacaatacggaaaacaacgaagcctggggaatcgtcgattttgaagtggcgaacgacgcctgtggcgcgggatacgtaccgacacttgccgatctgcaatcgctgtacgacgccaggcccggcggcaccatgaatacgcagcagggctggccgctggatggtaaaaactaccagaacagcaccgctgatttgagcaggagtacggaaaaccgctacgttaagtcgattgatctgcgcgatggcggtattagctcgctggcgtggagtgaacaactctatttcgtctgcttgcaaaacgcccatccggcggcgacgcagataacgctcacttcgcctttgtataacgacagcgacggatttgccaaagcgaaagtcggcgagaccatcccggtcatcatcaccacgcgggacgcccagggcaacctggccgccgacacgccggttatctttacgcgcggcgacagcgtcgggcgcgcgaatcaggaagtgaatagcgcgtcggcggcggagatacagataaaccacagcgacgggcgtagcagcggcgttaaatattacaccgccaccggcgctgacggcacgctgacgctgaatatcagccaggacagcggcgcgggctttaaaacgccgctgacggcggtgatagagcacaacggcgtaacgagcgcgctgctaccggtcatttttaccgtcgtcaccagcccggacacgccgaaagccaactactggggccatatggcggaaacgctgaccgacagcagcggcgtggtgtacaagcgcccgttgctggccagcgagttcagcgtcacgcccggcaaatcgctgaccatcgccaacggttactacgacaaaggcgaaacctggggcatgataaccgtcgataaagcctagaacggcgccggcggcggctgcgggcgcaattatctgcccaccgtcagcaacctccagacgctgtacagtacctggcctgataacgccatgcgcagttgtaacggctggccgatgaccagttctggcaacaataacgtcagccgctactggtgggcgggggattacgtgatgtcgtcagacggcgcgcagtcgctctacgcggcggtcaacctgtttaacgacggcaatgatgtcaaaacgacgaccagcaccacgacgtactatatgcagacctgccttacctcgccacgcagcgccgccgccagcctgacgctgacgctggcaggccaggatgcagccaccgggatcgcaaaagcgaaaaagggcgagcagatggccgccaccgtcacggtgaaagacgccgcaggtcagccgatgaaaaacgtgatggtgaaaatcagccggggatcttcgtacaaccgcgtcaacagcgccacatcgtcctcaagcgctgcagacgatattacgctgcgtaatgtgatgccgtccggcccggcgacatacctgctggatacctccgcgaaatatctgtatgcgcaaaccgatgcccagggacaggtgacatttacccttgcgcaggacagtaccgcaggtttaaagaccaccatcagcgccgccacgatggacggcagcaacctgacagacagcaaagacgctatctttaccgttatcaccagcccggatagcgacaaggcctcatactggggccatatgccggaaacctttaccaacagtaagggcgttgagtttgcgcggccgctgctgcgcgccgagctttcttcaacgacggataccacgtccttcctgtcaaataatgagcactggtacacctggaaccgctatccaaacctgtatcaggactccgccagcccgtgcgatcggctgggattgccgacgctggatgatttaaaaacgttgtataacgactatccgaatggtggactaacggccgcctttgggttgcctgtagacgcggggaaatactggggagcaggggattcgaaagtcaacgatacgcactcgacgaataatttccagtatatcaggctaaataacggcgttacgcaggtcacaaatacgaatacctcaacggcgcagctctgtctggcgaagcgcagggtgttggcgatagcgttgacctccagcgccatgaatgccgaaaaatccgccgcgctggcgaaaaaaggggataaaatcccgctgacggtgaccgtcacggacggcgccggcacgccgtagcccaatgtgcccattcggctggggcgaggaaactattcgcaaaaccgggctggcggtagtgacagcaccaacaacagcgacatgctgttaacgccgattgcgccgccagcggatgctaaagtatttgcctaccattattccggggagcagctctggtactggtacggcactacggatgagagcggcagggtgcagtttgagctgacgcaggataatacccccggcctgaaaacagcgctgcaggcgatgctgtccgacaatccgccgaccgtcagcaatatggatgtcatttttaccgtcattaccagcccggacagcgataaagccaaaatgtggggccatatgccggaaacggcggccaacagcgcgggggtgaaattccaccgcccgctgctggctgcggagatgacgtcgaatagcggcacctactattacaataacgaaacatggcctctggtgactatcgcgaacacccagaaagcgggcgcgaccacctgtgatgctgcatatcagccgttgtttaatgacctgcaaacgctgtatagcgaccatccagacagcgctctcaatacggcattcggctggccggtaggggcgggtaaaagctggctggcggtggaccaggagcctggaaccgggtattaccagtatctgcggctggataccggcgccaaaggccacaccagttccacgagcgtgtctggcgcgcaggtgtgtctggtcgagccgcatacgtctactcctgccaatattacgctgacctcgacggcgatggacagcgcgaaaaacgcggcggtagtggagaagggaagcgcgatgccgttaacggtgacggtaaaagatagcagcggtaacccggtcgccaacgtcggttttacgttgtcacgtggcgattcgaaaaatcgggcaggtacggtggtaacggatggcgacgtggcagcggatgccggagcagatgatctcatgcttaaagagctgactcccgcaagcgccagccgaagtatgaccaccaccgggattgtctttaccggcactaccggcagcgacggtacggcaacgtttacgcttaatcaggataaaagtctggggttaaaaacgccactcacggtgaaactgacggacaatacggctcttcacgcctcactggatgtgatttttatggtacttaccagcccggatacggataaagcgttgttctggggaaatatgtcggatacgacatccgtcaacggaaaaacgctgcatcgtccgtggctgcaggctgagctaccgtcaggcgtgacgccagtatttaccaacggagttcatgcaaataacgagtactgggcgatgacgcatacggtggacaacactaaatgggatattgctaaacagtgcggtagcctgagcaaagcaccggataataacgacctgttgacgctgtatcattcaattagctcgttaggctggccgacgctgggctatccctatttatctaaatcaacctcgggcggcggcatgtattgcggcgtggatgagaatactaagcagcaaaactgcgccattcagccggcaagtacagcaggttatgcgacgtgcgtggagtaacgtattaagcgtctggcacgaaaaataatttgtttttcacgttcaattgagcttcatgaaaaagtgatcggagcattcattgaaaagtatatgttctgctaattggagtcatcaccgtttgccgctggtgtgtagatgcgccgtttcccttctgtaacccggtatctggcgctacctatatacaaaataacaccaggtgtcgcatgataatcacaccttttatctcacgtatctatttatctcaatatatgaaattattaaatgttattcataatataaatatttattaaatagataaatatattcatattaattataaattaaccagaagctgacctggtattgaaataaggcttgaaattagttaataatttgtctttgataatacattgttacagatgacagcaaccattcatagaatcatatttttgttatttattatttaactcatttatatacaccatttaaaagctatttgcagccaatcaaatcaagtttgcttcgtgaatgttattaaaaggaaatttaaaaattgaacaggacctacagtatcgtctggagcgccgtgcgaaatatgtatgtcgtagcttcagaactggcgcgaagccacagcaaagttaaaatacaggcgcacgctaatgaagtcgccccttctattaaaaagcctgattcaggatgggcaagacaccatgcgctggccctggcaattgttgccgcgcttggctttgccagcccgctggccatcgccgataatccggtgtcatacaccgatggggtcaagcacgacctgagcgacgattcgccgatttcctactcaggcactggtgaaggttctgcactgcacctcgaaggccttgcaacgcccgaagggggctggcaggcaacgtcgggtacaggtacaaatgtcgtgattaacaccaacggcggcggcgatcctgttcagggaactcatgctatcgccacggcagttaccctcaacaagggcgcaacacttgacctgaccggggcgcagatctctacggaaggaacctacacggcaggtatcgacctccaggcgcaaagcagcatgacgctgaatggcgggagcatccagatcggaagtaattacggcatcctgaccctctctggcgagtcatgggctgccctgattggcaccgacgttacggcaacgacgcaaagccgtagcagcatagtgtcacaatcaggtagcacgcttaacattaaggacgggagcgtaattacgctgacaaacggccaggtgcgcgtagtaggcgagacgacatacaactcctggctgaatgtgtccgatagcacgatgagctccacgggtacggatagtacgcttcttgtgtccaacaagggcgttcttgatattacgaactctaccgtcacgcacgataatgccacaggcgccgctattgaggtgaaaaacgcctcaacggtgagcatctctgatgataaagattcgatggccatcaactccaaaggcatcggtattaaaatcctcgcctccagcgtggatattaacggcgccaccatcaacgccgacggcgacggcatctttataacaagcaaaggtaaaagcggtgggtatgatgatatcaacgcgctgacggttaacaaagcacaggttaattcagagacgattgcgctgcatgtggactctggcacgacgattaacgatcctatcgtgctaaccgatagcgcatttgacgcgccggcagtgatcaagctgggcagcaaggcggtcattcaggccgacaatacgacattgaacggtgacgttgttcagagtgacatgtcatcgtcatcgctgtctttaagccagggttccacgttaaccggtagtgtagatgcgatgtttactacactgtcgctcgacgatactagccagtggaatatgaccgactcgtcaatcatcggcaacctgaccaacaacggcgacattacgctgaacaacgagagcggttcgacaggcacgctgctgacggtgggcaataccctgaccttgcaggacggcagccagataaacgcgacgctggataccgccaacagctcgccaattatcaaagccgccaacgtgacgctggatgggacactgaaccttagctcagcggccacctttgtcgcgcccgaaaccgacgagcagttaggatcgttcacgctaattgattcgcaaaccgcgattactaccgattttgacagcgtaacgctggatgccgacacctctgctatgccggattacctgacgatcaacgcgggcgttgatgcgaatgataataccaactacgtgttgtctacgggcctgagctggtacgcggacgcaaaatctgcgcgcgttgcgcacggcacctttaccgttgacgcaggcgatacctttaccgtcaccagcgaactggatgaaaccgcggccacctccaactgggacggtaaaacgctgttcaaagaaggcgacggtacgctcgtcctcagcaacacggcgaacgacttcggcaataccgacattaacggcggtacgctgtctgcgaatgatgccgccgcgctcggcagcggcgacgtggccattgcagaaaacgcaaagcttgagttgagccaaggcacgctggataacaacgtgaccggcgagggccaaattgtcaaaagcggtagcgatgagctgatcgtgaccggcgataacaactacagcggcggtaccactatttccgacggcacgctgattgctgaccatgcagattcgctgggtaccggggctgttgccaacagcggcgtgcttcaggtcggcgaaggcgagctggaaaatacgctttccggcaacggttcgctgatgaaaaccggtacgggcgagctgacgttaagcggcgacaacacttactccggcggcaccactatttccggcggtacgctgattgccgccaacgttaacgcgctgggcggcggtgatgtcgataacgcgagtacgctgaagctggacgcggagggcgaattcaaccttgcgaatgtcacgacccagtctggagcaacgactgagctgtccaaaggtacgacgctcaacgtcgactcgctgactcagcaagccgatagtacgctgaatattgacctcagtaagactaatggtgaaagcgccattaccgctgacagcgtctcgttggctggtgcgctcaacattaccgggatcggcaacgtcacagacagctggacgcctgaggcatacacctacacgctgattgacagcgacagcgccattacgaccgatttcaatgatttgaccgtcgcgggaatgaatagcgaagatgttgacttcctgaccatcgacggaaaagtcgacgaagcagatagcacaaactatgatctgacggcctccctctcctggtatgcggacagagacaacgcttctaccgacgcccacggcacctttacgctaagtgaccctgacggcagctttaacgttgcggctaaactgacagatgttgatgacgcgctggatccgggcagcacatgggacggtaagtcgctgaccaaagaaggcgcaggcacgctgatcctctccggcgacaacgactacagcggcggcactacaatcaatgaaggtacgctggtcgccgccagcacgacggcgctgggcaccggtctggtggacaataacgccacgctggtactggacgcagacggtgaagtcagcgcggtgggcggcatcaccactcatggcggcgcgacgacccaactggcgctcggcacctcgttggatctcggcgacagcgcgttaattcaggaagatggcagtacgctgaacgttgagctgaatagtgactcagcgcaaccgctgattaccggtggcagcgccacgcttggcggtgatttggtcgtcagcgacgccagcctacaagcgcgcgcctccgacgcggagttccagtcctttaaactgatggatatggacagcgatatcagcggcgactttaccagcctgacgatgaacctcaccgacaagccggactatctgaccgtaaccggaacaatcaatcctcaagaccagtctgaatacctgcttaccgaagggctgagctggaatgcgaccgccacgtcagcgacgccagcacacggcaccttcactctgggcgcaggcgatagctttgaagtcaccagcgtactgggcgataaaaccggcaacggcggctcgctttacctgaataccgtcctgggcgacgatgattcggcgaccgataagttggtcattaccggcgatgcctccggcaccaccgatctgtacatcaacggcatcggcgatggggcgcagaccactaacggtatcgaagtggtggatgttggcggcgtatcgaccagcgatgcgtttgtgttaaaaaatgaggtaaacgccagtctgtatacctaccgtctgtactggaatgaaagtgacaacgactggtatctggcgtcaaaagcacagtctgatgatgacgacagcggtggcgatgtcacgccttcggacgacggcggcgacggtggcgatgtcacgcctccggacgacggcggcgatgtcgcaccacagtaccgtgcggatatcggcgcgtacatgggcaaccagtggatggcgcgcaacctgcaaatgcagacagaccctctatgaccgcgagggcagccagtatcgtaacgctgatggcagcgtctgggcacgcttcaaagcgggtaaagcggaatcagaggctgtcagcggtaatatcgatatggacagcaactactctcagttccagctaggcggcgacattctggcttggggtaacggccaacagagcattaccgttggcgtcatagcgagctacatcaacgccgataccgacagcaccggtaaccgtggcgcagacggtagccagttcaccagcagcgccaacgtagacggctacaaccttggcgtctatgccacctggtttgccgatgcccaaacgcatagcggcgcgtatgtcgacagctggtaccaatatggtttctacaacaacagcgtagagagcggtgatgcgggatctgaatcttatgattcaaccgctaatgctgtctcgctggaaaccggttatcgctacgatattgcgcttagcaacggtaatactgtcagtctgacgccgcaggcgcaggttgtctggcagaactactcagcggatagcgtgaaggataactacggcacccggatcgacggtcaggatggcgacagttggacaacgcgcctgggtctgcgtgttgacggcaagctgtacaaaggcagccgtacggttatccagccgtttgctgaagccaactggctgcacaccagcgatgatgtgtcggtatcgtttgatgatgccacggtgaaacaggatcttccggctaaccgtgcggagctgaaagtgggtctgcaggcagatatcgataagcagtggagcgttcgcgctcaggttgccgggcagactggcagcaatgactttggcgatctgaacggtagcctcaatctgcgctataactggtaagttagacaaaaccgggcgggtattccctgcccggttttgaggcgaatgacaaaccggttgagcgtcggattgtggctacaccttatccgacgtggcgcgtgggttggctgaggtgaagtcgaaacccaacatcgcgctgcaaaaggtgggggagtgttggattacgttcccggcgtgacggatttgacttcactttcaagccagccgtcctccagccgcgtggtcatgatatcgcctgctttgacctgtttgatctttttcaacaccttgccgtccgttgtcgtcgaaaccgtatagccgcgcgccagcgtggctaacgggctgaccgcttccagatgcgtgaccgcgttgccaaaacgctcgcgctgttcgcttaaccgtgagcggatattctccgtcagacgatattccagctgttggatgcgcgactgcacgcggtgaatgcgcggctgcggattttgctggctcaggcgttgacttacgcgttgctgacgctgagtggcctgcttaatcctggcctcaagcgcaaatcccatccgttggcgtagacgttccagcgcggtttgctgacgggccagacgtagttgcggatgttgttgttgcagacggtgaaaaatctgcgtgaaacgacggctgcggttggcgaggtagtagtccatcgccatgcccagacgctgctgggcggactggatctgacgcaacaactcctgctggttacggctgacaatttctgccgctgctgatggcgtcggcgcgcgcaggtcggcgacaaaatcggcgatagtgacgtcggtttcgtgaccgacggcgctgaccaccggaatacggctggcaaaaatagcccgcgccacgcgttcgtcgttaaaactccacaaatcttccagcgaaccgccgccgcgtccgacgatcagcacgtcgcactcgccgcgcgtgtttgccagttcgatagcacgaacgatctgccccggcgcatcgtcgccctgtaccgcggttggatagataataacgggcagggatgggtcacgacgcttcaacacgtggaggatatcgtgcagcgccgcgccggttttcgaggtgatcaccccaacgcagtgggccggggagggcaacggctgtttatgctgctgatcgaacaagccttcggcatggagtttggcttttagctgctcatacttctgctgcaacaagccttcgccagccggctgcatactttcggcgatgatttgataatcgccgcgcggctcgtacagcgtaatgttggcgcgtaccagcacctgctgcccgtgctgcgggcggaacgtcacccggcggttgctgttgcggaacatcgcacagcgcacctgagcggtatcgtctttgagcgtaaagtaccagtggcccgacgcaggctgcgtgaaattagaaatctcgccgctgatccatacctgtcccatctcctgttctaacagcagacgaaccgtctggttaaggcggcttacggtaaaaattgaggaagtttgagaggataacatgtgagcgggatcaaattctaaatcagcaggttattcaatcgatagtaacctgctcacgggggatcgcaagcactatttgcaaaaaaatgtagatgcaaccgattacgttctgtataatgccgcggcaatatttattaacctcccaggtgagatattgcccatgctacgtatcgctaaagaagccctgacgtttgacgacgtcctccttgttcccgctcactccaccgttttgccgaatactgctgatctcagcacgcagttgacgaaaactattcgtctgaatattcctatgctttctgcggcgatggacaccgtgacggaagcgcgcctggcaattgccctggcccaggaaggcggcatcggttttatccacaaaaacatgtctattgagcgccaggcggaagaagttcgccgcgtgaagaaacacgagtccggcgtagtgaccgacccgcagaccgtcctgccaaccaccacgttgcatgaagtgaaagccctgaccgagcgtaacggttttgcgggctatccggtggtgactgaagataacgagctggtgggtatcatcaccggtcgtgacgtgcgttttgtgactgacctgaaccagccggtgagtgtttacatgacgccgaaagagcgtctggtgaccgttcgtgaaggcgaagcccgtgaagtcgtgctggcaaaaatgcacgaaaaacgcgtagaaaaagcgctggtcgttgatgataacttccatctgcttggcatgattaccgtaaaagatttccagaaagcggaacgtaaaccaaactcctgtaaagatgagcagggccgtttacgtgtcggcgcggcggtcggcgcaggcgcgggcaacgaagagcgcgttgacgcgctggtggcggcaggcgttgacgtcctgctgatcgactcttctcacggtcactctgaaggcgtgttgcaacgtatccgtgaaacccgtgctaaatatcctgacctgcaaatcatcggcggcaacgtcgcgacgggcgcaggcgctcgcgcactggcggaagccggttgcagcgcggtgaaagtcggtatcggcccgggttccatctgtaccactcgtatcgtgactggcgtgggcgttccgcagattaccgctgtttctgacgcagttgaagcgctggaaggcaccgggattccggttatcgctgacggcggtatccgtttctccggcgacatcgccaaagccatcgccgcaggcgcgagcgctgtcatggtcggttctatgctggcgggtaccgaagaatccccgggcgaaatcgaactctaccagggccgttcttacaaatcttaccgcggcatgggctcgctgggcgcgatgtccaaaggttcctctgaccgttacttccagagcgacaacgccgccgacaaactggtgccggaaggtatcgaaggccgcgtagcctataaaggtcgcctgaaagagatcattcaccagcagatgggcggcctgcgctcctgtatggggctgaccggttgtgctaccatcgacgaactgcgtactaaagcggagtttgtgcgtatcagcggtgcgggtatccaggaaagccacgttcacgacgtgaccatcaccaaagagtccccgaactaccgtctgggctcctgattttcttcgcccgaccttcgcgtcgggcgatttatttaatctgtttcacttgcctcggaataagcgtcaatgacggaaaacattcataagcatcgcatcctcattctggacttcggttctcagtacactcaactggttgcgcgccgcgtgcgtgagctgggtgtttactgcgaactgtgggcgtgggatgtgacagaagcacaaattcgtgacttcaacccaagcggcattattctttccggcggcccggaaagcaccaccgaagaaaacagcccgcgcgcgccgcagtatgtctttgaagcaggcgtgccggtatttggcgtctgctacgggatgcagaccatggcgatgcagcttggcggtcatgtagaaggttctaatgagcgtgaatttggttacgcgcaggtcgaagtgctgaccgacagcgcgctggttcgcggtattgaagattccctgaccgccgacggcaaaccgctgctggacgtgtggatgagccacggcgataaagtgacggcgattccgtccgacttcgtgaccgtagccagcaccgaaagctgcccgttcgccatcatggctaacgaagaaaaacgcttctacggcgtacagttccacccggaagtgactcacacccgccagggtatgcgcatgctggagcgttttgtgcgtgatatctgccagtgtgaagccctgtggacgccggcgaagatcatcgacgacgccgtggcgcgcattcgcgagcaggtaggcgacgataaagtgatcctcggtctctccggcggcgtggattcttccgtaaccgcaatgctgctgcaccgcgcgatcggtaaaaatctgacctgtgtattcgtcgacaacggcctgctgcgtctcaacgaagccgagcaggtgatggacatgtttggcgaccattttggtctgaacatcgttcacgtaccggcagaagatcgcttcctgtccgcgttggctggcgaaaacgatccggaagcgaagcgtaagatcattggccgtgtttttgtggaagtgttcgacgaagaagcgttgaaactggaagacgtgaaatggctggcgcagggcaccatctaccctgacgtcatcgaatctgcggcgtctgcaaccggtaaagcgcacgtcatcaaatctcaccacaatgttggcggcctgccgaaagagatgaagatggggctggttgaaccgctgaaagagctgttcaaagacgaagtgcgtaagattggtctggagctgggcctgccgtacgacatgctgtaccgtcatccgttcccggggccgggcctcggcgtacgtgtactgggtgaagtgaagaaagagtactgcgacctgctgcgccgtgctgatgccatcttcattgaagagctgcgtaaggcggatctgtacgacaaagtcagccaggcgttcaccgtcttcctgccagtacgctccgttggcgtaatgggcgatggtcgtaagtacgattgggtggtctctctgcgtgctgtcgaaaccatcgactttatgaccgcgcactgggcgcacctgccgtatgacttcctgggtcgtgtttccaaccgcatcatcaatgaagtcaacgggatttcccgtgtggtgtatgacatcagcggtaaaccaccggctaccattgagtgggaataagtcgataacccttcctgtgttttcatgaacaggtaaaagtgaatttaaccctctgtttttgcagagggtttttatttatgtgcatagatgcattttctgtgtagtgcacagcttctggcggcaaagcactgcatcgacacaatagtgggtttcactggcagcacacaatcaaatctgacagtcggcttcgagcgaggtgcggacattggtagcttcaacaacatgactggcattgaggtgtattaatcaacgggaagcaggtcagtttactccgccagcccgacttttacgaaagggctaccatgactacgcgattttttgattagcttgccaacgtataatcctctgatttctggtgatgcgattcgtccaacaaattctgaacggttggtttcgggggggggatgaccaattcccgggtaaagtattgctgagagcctgccttcaaccagcactgtatctcgtaaacttccatcaccaaaccgccgtaggtggcgtatgcaaattgtaggttttcatcttttggtacttttgcccagacgccacgcgtagcttcatataatgcaagtgcactcatgccagacttgtaggtgctgtttagcaaaaaagcgagcccggcatgttcaggtgcgatttccgtctcttgcttaagaagaagatgattgagctcatccagcgtgattcgccccataagggagctgcttcctcgtactttgttggtcagttctccaacacccaagagatcaatacatgttgcttcaacaagcttcgcggttgcctcatccatgccatggcgtagtatgtcgatacccagatttcctgtttttaacagatgattaattcgttctgatttcggagagtcatcattatactttatatgatcaaggcagcgttctgacttgcctttgcctatataaaacggcttcttagctgcatcttcagtgtcataaaatgcataaacatagaacttagccatccctaacgcttttgagtattttgaaaaatctttcaaaccttgcttccttaaggcaaaagtacttaattttactatcggcactatagttcagaacttaagcgcaaaacaattagcgtatagattgacctgcgtccattgatgaatatgggccaaagttaacaacgtccgctattggcacagacctgcctgtcagattaggtttaggtctgtgccatagctatgtcaggtcaaatctgagctaatacacataaatgattagcgaaatcagttaaaccagccgcttgccttttcctcacgggctttaccttcgctttgcagcagatcgcgaccgccttcagatagatttctgtttgcatcagcatgagattgaataacatctgtctgggcagctttacttttcagctcttgatcgatgaattcattttctctttttacccgggcctcttccctggccagcgccagtttttgtttctgaatttctaaacgacgaagctcatcttcgtagctttgatcgcgcgctttatcttgcgcggcttccgctgccaattttgcttgccgtgctttccgttcagcttctgccgcttttgctcgctgcttagcaaccgctgccgcattggcttgcctttgtctttcctgttgagcctcttgatctcgtttggcttgcagagcatcacgctgtctgttttcttcattttttccttgctgttcagcctgggctaccgccgcaagctgatcctgcaaagaagaagataaaaccgagccgcttagagtgaataaaacagcgcctaaaataactttcttcataaaatctcccgatagttagcttttctcaggacatttcgtattgggttgaattcgcgtttcgttatctttggtcgatatcaccatagccagaccggtggtaaattggcacgtttttcccacctgggtggaggtataaaccttcgttccttctttgtaagtcaaagatacggcttcaactaacgttttatctttaaccaatgaccccgccgctgcgccaacggctccgccgccaaccgcgccggcagtagtacccaaaccgctacctgagcccacgttatgaccagtaacgccgcccgctacagccccaagaattgcgccgaaggtctgagcggtttttttattggcggtgttatctacggcaactttcgctggcaaaacagagataatattgacggtctttgtttcttgcttcgcgtttaactgcccggtttggtaaacatctgcggcgtagtcatccgcattggactggcatccggcaagagaaaaagaggcaaacaaaaccagaggcaaagcattttttttttaaattcatcacaattccttgtttaggtaataacgcaaaaaggaatgtatttaagactaatcttaaaaaaagtaaactatcgtttcttgtagttgattgttttttttagactaaaaaacaaagcattagatgatacgatgctttgtttttatcggttcatgctaagccagggaaggggataacagagcgctggataacacggcaaacctgtgacgataataccgccatcactattttaacggataacagcttaacgttgtcccggcgtggtgaccgaaagcgatgactgttgcgcttcttttttatcctgatggtgctgccaggcgccgatagaagagtagacgaaacgtccaaagaagaagagaaaactgataagcagtacgatacgggtcatgcgagtgttaaatcgatgtcgttttcgcatactgttggcctgacttacaaagggttccttaacgttggcccagcggtatgggcgggatcaggctgggttcttcaaaggtattatcaaggcgaagaacgtaacaagcctgcgttcactctacattaaggcatactgcgaaccgatggtcaattcctcttaatgtaaaattgcgtcagttgatttatcttatattgttatggaagataattttagtatttacattaataataaattaatgataacaaagaataaaaagacgaataaaggctgcaggagaaaggtaataattgacttaaatcaaatgttacttttgtttaataattacaatcgatgactatcgtgtgatgtatatcgcatcatcaatttaaagtcaggtgggatgcctgtctgttaacgcccctttgggattggggggttctgctgagcatctatgaagctgaataaaacttatataaatatcagagataaatggtggggactaccgctcattctcccttcgattttactacctgttttaagtagcgcaaatacttatgcgcttaccagcactggaaatgtggttcttttttacctgccgttagcttttatgcttagtctgatgctctttttcggctgggcagcactgccgggcattgtgcttgctatcttctggcgcagatacccgcagacagggctgtatgaaaccctttctgtgacgatgcactttatcattactatcgtgctaagctggggcggctatcgtgtcttttccccccggcgaaacaatgtttcccacggcgacgcccacctgttgtttcaacgaatgttctggcaggtattttgttcagcgacattatttctggtcatttaccagtttgccgcttttgttggcatgtacgaaagtaaagccagcctgatgggggtaatgccctttaatatcaacacgctgattaattaccaggcgttactggtcggtaaccttgtcggcgtgccattgtgctattttattattcgtactctccgcaatccgctgcacctgcgggggtattatcagcaattaaagctacagattgatagcaaggccactaaaaaagagatcgttatttggctggctgtattgactacactaatgtttatactgtgtatgccattgacggataatagctcaatatttagtaccaactatacgctttcgttattattgccggtcatgctgtggggcgcgatgcgctatggttataagtttatttcaattatctgggccgtcgtgctaattacgtcgattcattattatcagcgttatatgccctggtattcaggttatgatacgcaattagcgattacctcttcgagctatctggttttttcttttattgttaattatatgtctgtactggccacgcgtcagcgcgtagtgagtggtcgcgcacggcggctggcctatcttgacccggttgtacatcttcccaatttacgtgcgttaaaccgcgcgcttaaaaatgcaccctggtctacgatctgttttttacacgtgccgggtctggagctattgggtaaaaattatggcgtcatgctacgcatccagtataagcaaaagctctctcactggattacgccgatgttggcctcaaatgagtgcgtctaccagatgtcagggcacgacctggtgctgcgtcttaatacagaggcgcatcagcagcgtattgaagcgctggataaacatattaagcagtttcggtttatttgggatggactgccgctacagccgcctgttggcgtgagctactgctgcgtgcgttctccggttagccacctttatctgctgttgggcgaattaagcaccagttccgatctttcgttgacgactaacgcgccggaggatttacagcggcgcggcgcaatgcacctgcagcgcgatttgaagggcagaattgcgatgatgaatcgcctgcaacaggcgttggagcacgatcattttttcctgatggcgcagcctattttcggtgttcgtggggacgtttaccatgaaattttactgcgactcagggatgacaacggcgacgttatcaacccggacaattttttacccgtggcgcatgagtttggtttgtcttccgctatcgatctctgggtgattgaaaacacgctacggtttatggcggccagccgggaatatatgcccgcgcatcgttttgccattaatctgtcgccaacatcggtatgccgcgcccgtttccctgcagaagttaagcagctgcttacgcaatatcaggttgaaccctggcaactggtttttgaggtaacggaaagcaactctctcaccaatgctgagcaggcgcagttgacactgggacagctacagcagtttggctgtcagatagcgattgatgatttcggtactggctacgccagctatgcgcggctgaaaaacgttgacgccgatattcttaaaattgacggcagttttattcgcaatatagtgtcaaacagtctcgattatcagattgtggcttctatttgtcatttagcgcgaatgaaaaatatgcaggtcgtcgcggagtatatcgagagcgaagaaatacgaagcgtagtgctgtcgttggggatcgactatcttcagggatatttaattggcgagccgcagctattatctgagattcagtaaaggcagacgccgcagcgcggcgtctgatccacaatttacgcggcgatctccggcgagctttcttcctcaatattgagacgccagccagttaccgcttcccagtactgctgttctttttccagatcaagcagtaccagcgcattctggctgaaccagtcatgcggaaaacataacgtccagtggctgtcatcggtcgttagccgcagcgtcggcggtgtggtggtcgcctgccgctggttgttcagtaatacgcccagccgaagtagctgaattaacggcagatactgttttttcttaaacagcgtaaagcggggcatatcatccagttttatggctttacgatgataacgcaccagcgtcgccatcatcatttgctgctcctgattaaagccgggcaaatcgctgtgttgcagaatataagccgaatggcgatgtaaaccgctgtgattaatattcagtccaacctcatgcagcattgccgcccagcggagcaacgcttcaagctgcggatgcgccagttttggctgctgggcctgccactgctcgtacatctgcatggtggtttccagcacacgtctggcctgttctctgtcaatgttgtattgattggccagactttttgcggtacggctgcgaacatcctgatggcggaagcggccttccatttcatacagcacgccttcgcgcaacgcgccgtcggaaaggcgaagctcgcggatagccagagcatcaaaaacgccgcacagaatcgccaggcccggcacaaagaccgcttttcgttcttcagacagacccggcaggctgagcgcattaaaggagcggtgcttcaacacttctgacttcagtttatcgaggcgctccggcgtaatgaagccatctttctcacccagcgccaggagaacttcatgagcggccttaatcgtaccggaagcgcccatcgccacgttccaaccctgaatacgatactgccaggttaaggtttccagtttttgcgctgccgccattcgggcgcgctggaagttttctttattgataacgccgccgggaaagtagagctgcgcgaagctcacgcagcccatacgacggctttcaaccagcctgggttcgaagttttcgccaataaccagctctgttgatccgccgccgatatcgatcaccagcttgcggcctttttccggctgcgtatgttctacgcccataaaaatcaggcgcgcttcttcgttaccggaaataatctctatcgggtagggaataaccttttccgcgcgtttgagaaaatcagcggcattttgcgcctgacgtaacgtatgggtgcctacgatacaaacgctggaaggggagaaaccttgtaagcgttcagcaaacagcgacagacagctaagcccccgttccatggcttcttcgctgagtttgttatctgcgcccagcccgtccgccagatggacgcgctgttttaagcgcccgataatctgcattgcgccgtcaaccacgcgggcaatgaccatatgaaagctgtttgagccgagatcgaccgcagcgaactcctgcgggcgaggggatttatcgtaaattggcatagcgttagtctggttgctcgagtgatttgatgtagtcataaattgccagctgcgcctgaactttgcggcgattgccgcgcggtacgtagcggttgctgagttctttatcgataaaacgcgcttttaccgtgtcgctaaacagaatgtcaatgatatccaggacgcgttgtttaagccgcgggtcgaggataggcgtagcgacttcgatacggtagtcaatattacgcgtcatccagtcagctgaagagagccaaacttgcttatcaccgccgttttcgaaaatataaacccgatcgtgttccagatagcgatccacgatgctaatcgcgcgaatattatcgctaatgccttccagttgcggaataagagaacacataccgcgcaccagcagattgacctggacgcccgaacccgacgcggcgtatagcctgtcgaccaaccctttatcgaccaggttgttaagctttaaggtaatccctgacggtaagccttgctgggcattggcaatttcacgatcgatcatctcatacagcagacgccgtgagttttgtggagaaaccatcaaataatcgaaagtgaccgggcgataggggttttcaataaaattaaagacccggcgcacttcattggtaatgcgcgcatcggcggtcagcagcgaataatcggtatacagccgcgccgttttttcgttgaagttaccggtgccgatatgcgcataacgcaccacgtcatcgccctcttttcgtgagatgagaaagagtttggcgtgaattttcagcccgggcgcagagaaaataacatggacgcccgcttcggttaaccgcttggcccagtgaatattcgcctcttcatcgaagcgcgcctgcaactccaccaccacggtgacttttttgccgttatgggcggcatggatcatcgagtcaataatgcgcgagtctttcgctacgcgataaatattgattttgatcgccagcacgcttgggtcaaacgacgcctggcgcagcagttccagtacatgctcgaaggtatggtacggataatagagcagcacatcacgttcacgaatcgcgtcgaaaccgttacgaaacttctctttatcaaaccaaagatggcgtaaccgcggtaacggtttattgaccaggttggctttaccgacattcggaaaattaataaagtctttaaaattgtggtagcgcccgccgggtacgattgagtcataccgggagatcgtcagtttttcccgcagcacgtcgaccagcgcggcgggcatatcgcgttgatagacaaagcgcacaggttcagcggtcaggcgctgcttcaggctggaggacatcagctccatcagactggattccatctcatgcaccaggtcatattcggcatcgcgggtcattttcatcgaataggcattgagcgcgtcatagtcgaagaaccctttaaaaatgtcatccaggcagtagcgcagaatattatccagtaggatcatcggcttgcgtctgcgcggtgtctccggcggcagattaacgaagcgtgggactttgtcggacggtatctccagcagcgcatagttgatggtgtcgccgcggataatctccaccgccagataggtgtaatcatcttttaaaaactgaacaagatccgtctcccggttaatgagaatcggggtaatatgctggcgcaaatagtgcttaaaatagtggcgcaaccagctttgttggttcaccgagagctgacgctcgttgatcagaaagatttgattacgcgccatttccagcagtaattcgttgtacaggccgtcgaacccctggtctgctttcaacacgcgggactgaattttgcctaacaaatggcgtgaatgagaatttgaaccctgttcttcgctgataataatgcgtcgtttcagttcagcgaaacgcactttgtagaactcgtcgaggttattagaatagattcccaggaaccgcatccgctcaatcaacgggttggatttatccgctgcttcctgtaacacgcgttcgttaaatgctaaccagctcagctctttctcgatatatagcttttcctgacccattactacctatactccgttttattcacgggacactgcctgataattatggcgagcattacgcgttaatgtccaacagcgtcagaaaaatatgacaataaactgatagcataaaggaagggaaaagagtaggccggataggcatttacgccgccatccggcaagcagacgcagccctggccgatgacatattattcgtcagacgcataaccttgcggcggcagacgacgcccgtccagccaggcggcgttatcgcgcatctttagacgcccctgcgcaaaccagccaatcaccagcggataaatcgcatgttcctgagtttgtacgcgtgcggtgatatcatcttcgctgtcgttggcaaaaaccggcaccttcgcctggagaatgaccgggccgccgtcgagttcgtctgtcacgaaatgcaccgaggtaccgtgctcctcatcgccgttttccagcgcctggcgatgggtatgcaaccccggatattttggcagcagggaagggtgaatgttcagcagacgcccgtagtaatgcgcgacaaacatcggactcagaatacgcataaaaccggccagcacgaccacatcgggcgcatacgcgtctatcttgcgaatcaactcgcgatcgaaggcgtcgcggctgtcaaaccgatcggcagtcagcgcttgcgccggaatgccggcttctctggcgcgttcaaggccgaacgcgtcggccttattgctgaatactgccctgagggtgcctttaattttcttcgcttcgcaggcatcgataatcgcctgtaaattgcttccattgccggaaatcagcaccacaatattcattattcaataaccacacgctgttcggaatcagaggctttgatgataccgattttccatgcgttttcacctttctcgtttagcagagcaagcgctttgtccgcttccggagcagagagcgcaatcaccatgccgacgccgcagttaaaggcacggtacatttcatgtcggctgacattaccggcggttcgcagccaggtaaagatggcgggccactgccaggacgactcattaattaccgcctgggtattctccggcagaacgcgcggaatattttcccaaaagccgccgccggtgaggtgggcgatagcgtgtacatcgatgttttcaatcagttccagaaccgattttacgtagatacgggtcggttcaagcagatgatcggccagcggtttcccttccagcagagtggtctgtggatcgcagccgctaacgtcaataattttccgcaccagcgaatatccattcgagtgcgggccgctggagccgagcgcaatcagcacgtcgccttcggcaacccgggagccatcgatgatttctgatttttcgactacgccgacgcagaaacccgccacatcgtaatcttcgccgtgatacatgcccggcatttccgccgtctcgccgccgaccagcgcgcagccggattgcaggcagccttcggcaataccgttgatcacgctggcggcggtatcgacatccagtttaccggtggcatagtaatcgaggaaaaacagcggttccgcgccctgaacgaccagatcgtttacgcacatcgccaccagatcaataccgatagcgtcgtgacgctttaagtccatcgccaggcgaagtttggtgcctacgccgtcagtgccggaaaccagtaccggttcacgatatttttgcggcaacgcgcacagcgcaccgaaaccgcccagaccgcccataacctccgagcggcgagttttcttcactacgcctttgattcgatcaaccagagcgttacccgcatcaatatcgacgccggcatctttatagctaagagaggtcttatcggtcactgcctggttccccacgttttttcttgcggtaaaagttaaattcggcgcaattctaacagggaaagcaaacgtttgcgagcgtggtctgcgccctggttatccgggcgattttttggcatggtttcggtcgctgcttgaaaatttccctgttggtaaaaaagaaaaggatatccagcacttggtttacgacaggtggtcgggacaggtcattcacccttaaaattgctaagattcaatcggttgttagcttttatcgccagtttcaacgtgagtgatttatactcacttttccgctatcagcgcttttggttgatccaggtcaagcatacattgtgttgcgtcagagaggaaaagcggtataatccggcgattttttttgtggttgccagtcatctgaggataggagaagagtatgaagatcgtggaagtcaaacacccactcgtcaaacacaagctgggtctgatgcgtgaaaacgacattagcactaaacgctttcgtgaactcgcctcagaagtaggcagcctgctgacgtatgaagcgacagccgacctggaaacggaaaaagtcaccatcgaaggctggaatggcccggtggaaatcgaccagatcaaaggtaaaaaaattaccgttgtgccgattctgcgcgcggggttgggcatgatggaaggcgttctggaaaatgtaccgagcgcgcgtatcagcgtagtcgggatgtaccgtaacgaagagacgctcgagccagtaccttatttccagaaactggtatcgaacattgatgagcgcatggcgctgatcgtcgacccgatgctggcgaccggcggttctgtcatcgcgaccatcgacctgctgaaaaaagcaggctgtagcagcattaaggtgctggtgctggtcgccgcgccggaaggcattgcggcgctggaaaaagcgcacccggacgttgaactgtacaccgcctctatcgatcaggggcttaacgagcacggatacattattccggggcttggcgatgccggcgataagatttttggtaccaaataagtgaataaataattaaaagccgactttaagagtcggcttttttttgaataaaaccactaataacaaacacacttagaggaaaacactatgacgcgccgtgctatcggggtgagtgaaagaccgccgcttttacagacaatcccgcttagtttacagcaccttttcgccatgtttggcgcgaccgtgctggtgccagttctgtttcatatcaatcccgcgacggtgctgctgtttaacggtatcggaacgttgctgtatctctttatctgcaaaggtaaaattcctgcctacctcggatcgagctttgcctttatttccccggtattactgttgttgccgctgggttatgaagtggcgctgggcggttttattatgtgcggcgtgttgttctgtctggtctctttcatcgttaaaaaagcgggcaccggctggctggatgtgatgttcccgcctgcggcaatgggcgcaatcgttgccgtcatcggtctggagctggctggcgtcgcggcggggatggccggattgctgcctgcgcaagggcagtcgccggacacgaaaacaattattatctccatggtcacgctggcggtgacggtgttcggctccgtactgtttcgcggtttcctggcgatcattccgattttgatcggcgtgctggcgggctatgcgctgtcattcgcgctgggggtggtcgataccacgccgattgcccaggcgcactggtttgcgctgccgaccttctatacgccgcgttttgaatggtttgcgatcctgacgattctgcccgcggcgttggtcgtgatcgccgagcatgtcggtcatctggtggtgacggcgaatatcgtcaaaaaagatttagtgcgcgatcccggtttgcaccgctcgatgttcgctaacggactgtcgacgatcatttccggtttcttcggctccacgccgaataccacctatggggaaaatattggcgtcatggcgatcacccgcgtttacagtacctgggttatcggcggcgcggcgattttcgccattctgctttcctgcgtcggcaaactggcggcggcgattcagattatcccgttacccgtgatgggcggcgtctcgctgctgttgtacggcgtcatcggcgcgtcggggattcgcgtcttgatcgaatcgaaagtcgactacaacaaagcgcaaaacctgatcctcacctcggtgattttgatcatcggcgttagcggcgcgaaagtgcatatcggcgcggcagaattgaaagggatggcgctggcgaccatcgtcgggattggcctgagcctgatttttaaactgattagcctgttgcgtccggaagaagtggtactggaggcaaatgatgcggagtctccgcatcagtaacgggttgccgggcagcgatgctgcccggttctatctcacgggaattatgtggtaaactcagcgcgattttatgtcatcctgggttgaggtatctctgaacacaccggcacagctctctttgccactttatcttcctgacgacgaaactttcgcaagtttctggccgggggataacgcctctctactggccgcgttacaaaacgtgttgcgccaggaacatagtggatatatctacctttgggcgcgtgaaggcgcgggccgcagccatttgctgcacgccgcctgcgctgaactgtcgcagcgtggagatgcggtaggctacgtcccgctcgataaacgcacctggttcgtgccggaagtgctcgacggtatggaacacctctcgctggtgtgtattgataacattgagtgcgtcgctggcgatgaactgtgggagatggccatctttgatctctataaccgcattctggagtccggtaagacgcggttattgatcaccggcgatcgtccgccaagacagttaaatctgggcttacccgatctcgcttcccgtctggactgggggcaaatctataaactccagcctctttccgatgaagacaaacttcaggcgctacagttgcgtgcccgattacgggggtttgaactgccggaagatgtcggacggtttttactcaaacgtcttgatcgcgaaatgcgcacgctgtttatgacgctggatcagctcgatcatgcgtcgatcactgcccagcgaaaactgacgatcccgtttgtcaaagagatcctgaaactgtaatacgccgcgacggcggcgtttaacggttaaccgaggatgtccagcacctgctcaggcggtcggccaatacgcgcctgaccatttgccactacaatggggcgctccatcagtttagggtgttcaaccagcgcctggattaacgcctcttcacttagctggctatccgccaggtgaagcgtcttatagagatcttctttctggcgcatcagttcgcgcgcgctggacatgcccaacatacgcagcagttcccgcacggtggcggcatcggcgggcgtatccagataaagcaccacttccggttccacgccgttagatttcagcaggttcagcgtgtcgcggctcttcgagcagcgcgggttatggtagattttaatcgtgtcggtcatgagttctccttgtgacgccatccggctaataaacggcgattacattttcgtgtatggcttgaagcgttcctgtaactggcgcaactggtcgatacgcgcatcgtaacgcgcctgttgctgactacccagttttgcctgggcgctggcgctgctgagcagtgaaattgcctgatccagtcgtcccgccagcgcataactttcagcgcgtgccgccagctcctgatcgcggttgttcagcgcggcttcggcctgagcaagcagatcccagccgttaccgtcatctttatggctaaaggtgtagcgattcagaatggtttccgccgctttcggctggcctccctggaggtacgcattggcgaggtttaactgcagcacaggattaacgcgcagatcgcgggcatttttcaggcgattaatcgcgtcgttggctcttttctgccccaggtcaatatcggtggcgaggtcaagataccaggcattgttcggctctgcgcttaatagcggctgcaacgttttgcgcgcttcatcgtacttgctcgcttccatcgcctgcaacgcccggccatattgcgccgcatgttgctgacgcacgttgcctttagaccactgatccagcaggtcgctggtgagctggttacgtccggaattgtacattcccagggcgcgcgctttggcgaaataaaagtcggcggaagattgcaccacgaccgggcgcatctggttggcacggttgcgggcatccgcaaggcggctttccggtaaggggtgagtgagcaaaatttcaggcggtcgcgtggagtaacgcgcctggtcgagcagtttttcgaggaaagagggcatcgcctgtgggtcaaatccggcgcgttgcagtacctgaataccaatacggtcggcctcttgctcattttgctgggtgaaacttatcattccctggcgcgttcccgccagagtaccggttagcgccgccataccggcctgtgggctggccatggccagcaaaatggaacccagcgcgcccacccaggtaagcggcgcgctgcgcttttgatcttccatcgcgcgcgccagatggcgctgcgtaacgtgggaaatttcatgcgccatgactgaagctagctggctttcgttatccgcgtagcgaaaaagcgccgagtgcagcaccacattgccgccaaagaacgcgaacgcgttgatttcgtcattattgatcaagaaaaaatggaagggcgttttgacggagtctgcgtgcgagaccagacgcatccccagcgcgttaatgtattgcaccagcagcggatcgttgattaacggcgcgctgccgcgtagctggcgcacataaaagtcgcccatttgcatctcttgtccaatagaaagcgtgcttcctgccgaggttcccatatcgggcagcgtgtcggcagggtcggcaaatgcgggcgcgacctgaccgagagccaatgctgcaatgagggttgccaccaggttttttttcaactgcctgaacataacctctatcctgttgttttgagatagccctttgaccaacgtcgtgaaatatcgttccacgctccgacacttcataagtgtaactgtgatgagcacagactcactattttagtttcctgaatcaacgataaaaagcgaagtcttttttgtgacatttcgatacaattcggcatcacaatcccgcagttgagttctgggaagggttttatgctcgaaatgttaatgcaatggtatcgccgtcgcttcagcgatccggaggcgattgccttgctggtcattctggtggctggttttagcatcctctttttctttagcggcctgttagcgccgctgctggtcgctatcgtactggcctacctgctggagtggccgacggcgcgcctgcaggcgattggctgttcccggcgctgggcagcctccattgtccttatcctctttgtcggcattctgttattaatggcgtttgtggtgatgccgattgcctggcagcagggtatttacctgattcgtgatatgcctggtatgctgaataaactgtccgattttgccgcgaccttgccgcgacgctatccggcgctgatggatgcgggcattattgatgcgatggcggaaaacatgcgtacccggatgcttaacatgggcgattcggtggtgaaatattcgctggcttcgttagtcgggctactgacgctggcggtatatctggtgctggtgccgctgatggtctttttcctggtaaaagataaagagcagatgctgaatgccgtgcgccgcgtgctgccgcgtaatcgcgggctggcggggcaggtgtggaatgagatgaatcagcagatcaccaactatatccgcggaaaagtgctggagatggtagtggtgggcgtggcgacctggctgggctttttgttgtttggcctcaactattcgctactgttggcggtactggtgggcttttcggtcctgatcccctatatcggcgcctttgtggtgacaattccggtggtgggcgtcgcgctgtttcagtttggtctggggacggaattctggagctgttttgccgtttatctgattattcaggcgctggatggcaatttgctggtaccggtacttttctccgaagcggtgaatttgcatccgctggtgattattctgtcagtggtgattttcggcggtctgtggggattctggggggtatttttcgccattccattggcgacgctgattaaagccgttgtccatgcctggccggatggtcaggtgacggatgcctcatcctgagcggtctgtacaaaagttgtaaagcgtgaacgacatcatagtgccctgccgccattttgcgcacgcctgatgagggtcaagcgcttagaaagccgctcttttttttaatgccgcaccgtgttgcggcatttttattgtcggaacctacaaaattctcgctgtaaagccgccaaaatttggtgacttagcctaagcattcttctgagaaattcgttaataagtgacatcattgatgcgagattgcttttttaatgtgaagcgataacgaaacagggaatgagtgtgttgagaaaacattacttgaaagggtataccgcgcggcaaattgtacagcgagccatgaaaattattccttactcggtaaacgtcatggatgagcatggcgtcattatcgcgtctggcgaaccttcgcggcttcgccagcgtcacgaaggggccattctggcgctgaaggaaaaccgtattgtagaaattgattccgctaccgccaatcagcttaaaggcgtgcgatccggcattaatcttcccatctcttttcatgaacagcttatcggcgtggtcggcattaccggcgaaccggaggaggttcgcgcgtatgccgagctggttaaaatggcggcggagctggtgatcgagcatatggtgctgatcgaacagtgacaatgggataaacgctatcgcgaagagctgatcaaccaattgattttgcgagaaaattcaacagagtcgttgcgctccatggcggcctatctgggcattgatctggcggttcccagagtggtgctgattattgaactttcccagccggatcgcgaagcgctgcgcaatgtaatggattatttcgagaatcacgcgcgcaaccatttggtgacgtttaccgaatttaatgaattaatcattattaagcctatcacgttaaaagagggaaagtggaatacccgccaggaaatgggcgaattgcagatttttaaatcatgggctgcatcatcgggctttagccgtattttggttgggggctattttgccggcgagacgggattgcaccgatctttgctcacagcgagagccacgcaggcgatggcgaaaagacaaaagctgcgcagccagtacattttttatcatgaccacgcgcttcccgcgctgctaagcgggctgtctgaaagttggcaagtgcaggagttatcgcgtctgtggctgcaactggtgcaacatgacgcgaaaggcgtattgcaacagacgctgcggacttggtttgaacataattgtgacctgacgcaaacggccaaagcattgcatattcatgtgaatacattgcgctatcgcttacagcgctgtgaggatattacgcacataaaaatcaacgagttaaaaagtacgctttggctttatatcggtatggagcttcaggccgaatctgtatcgtccgacaagttaccgctgcctggtcgaatcgaaatttgttgaaagctccagcggatttttaggcggttttttccatactgcgcgctccatgttaaaggaggcgcagtatatgacgtcgatatccaccttgggagccattgccgcattggttgtggccatcgtattaattttaagaaaagtgtcgccagcctacggcatgatggcgggcgcgctggtcggcggtttgattggcggcgccgatcttctgcaaaccgtgtcgctgatggtgtcaggcgcgcagggcatcgttaatgccgtattgcgtattctggccgcaggcgtactggcgggcgtattaattgagtccggggcggcgaatacgattgctgagacgattgtccgcaaagtgggggaaacccgggcattattggcattagccattgccacactatgtttgaccgccgtcggcgtatttattgatgtggcggtgattaccgtcgcgccgattgcgctgtcgattgcgcgtaatgcaggcctgtcaaaaagcgctattctgctggcgatggtcggcggcggcaaagcgggtaacgtgatgtcacctaacccgaacgctattgccgcctccgatgcgtttcatgttcctcttacctctattatgctggcgggcgtggttccgggcatcgttgggcttattatcgcctatctgttagcgaaacggctgaataataaaggcgcgggcgtcgccgatcatgaagtgactcaccatgatgactctgtcgccaggcccggttttctggtggcgattagcgcgccgctggtcgctattttcctgctttctctccgtccgtttgtcggcatttccattgacccgttaattgccctgcccgtagggggattggtcggtctgctgttgatgggacgcgcgcgccactgtaaccagtacatggtcgccggtctgatgcgtatggcgcctgtcgctattatgttgctgggaaccggtacgctggccggcattatcgctaattccgaacttaaagatgtcctgattcatggcctcaccgcttcgggattgccgtcctggctgctggcgcccgtgtctggcgccatgatgtcaatggcgacggcctcaaccacagcgggaacggcggtggcgtccggcgttttctctcccacgttacttgaacttggcgtttccgccctggcgggagccgctatgatccatgcgggcgccacggtgctggaccatctgccgcatggcagctttttccacgcgacgggcggcagcgtcaatatgcaaattcatgaacgtttaaagctaatgccgtatgaaacgctggtggggttagccattacctttatttctactctgatgttcggtttctttggttttgcaggataatccctatgaaaattgttattgctcctgattcatttaaagaaagtttgtccgcaatggcggtcgctgaggcgatagaaaaggggttccgcgaaatttatcctgacgccgactacgttaaggtgcccatggcggatggcggggaaggaaccgtgcaatcaatggtggaagctagcggcgggcgttatgttgaccagtgggtacaaggcccgcttgggcaaccggtaaccgcgcgttggggaatgctgggcgatagcgataccgccgtgattgaaatggcggcggcatccgggctgcatcacgtttcgcctgaattgcgtaacccgcttaatactaccagctacggcaccggcgagttaatcgtcgcggcgctggagcgtggcgtaaagcgtattattctgggaattggcggcagtgcgacgaatgacggcggcgcggggatgatgcaggcgcttggcgttatattgcgcgataaacaggggcgctcgctttctccgggcggcgaggcgctggcggcgctggcgtctatcgatttgtccggttgtcacccattgctgcgtaaggtatcgataaccgtggcgtgtgatgtcaacaatccgctgtgtggtccccagggcgcatcggccatctttggcccacaaaaaggggcgacagcggaaatggtgaactccctggacgcggcgctggaaaactggggccgacatatttatcaggcaacgggacgtgaggtgattaacgctcccggcgcgggcgcggcaggcggaatgggcgccgcgcttttagggttgctcaatgcggaattacgcgccggcgtagagattgtcgtggaaacgctacagcttgagcaggcggttaaagatgccgatctggtgattaccggagaagggcggctggacagccaaagtatttgcggcaagacgccgattggcgtcgccagagtggcgaagcggcatcataaaccggttatcgcgctcgccggtgggctgcaacacgatcatcacgttgtgtatcagcagggtatcgatgcggcgctatcgattttgtcgcatatcgttacgctgccggaagccttacacgaggcggaatataacctgagcctgtcggcgcgcaatgtggcggcgatatggcgtctggcgcggcaagcctgacggcgcattccctttccaggccgcacatcagcgcggcctgaggcttttacgcgttttctttcagccagttcagcaccacatcatggtgattgctggttttaaaatcattaaagacgtgctcaatcttaccatcagcgtcaatcaaaaagctgatgcggtgaatgccgtcatacgttttgcccataaacgacttttcgccccagacgccaaactgttcacacacctgatggttttcatcggacaaaagggtaaagttcagcagctctttttcagcgaaacgggagagtttttcaggtttatcggtgctgatgcccagcacgtccacgcctgcttttttaagctcgtccatgttatcgcgtaagccgcaggcctgcacggtacagccgggtgtcatggcttttgggtagaaataaaccagaacgcgctgcccctggaagtcggtcaaatttacttgttccccgtcttgatccggcaagctaaatttcggtgcgatatcaccggctttcagtggattcattacttaactccatcctgttcatcatgttgtgagtaattgacgacgtttatactgccttgcgcattgagttctgtacatagtgctttaaaggcttgctcaatatttgcggaattttgcgacgccgggctatgtgcggtgatttgaataaataattgcgcagctttatcatcttcagccggctgcgtgcgggagaccagctccgcaatattcatttcatgactattaaacagcgcggtgaatcgctcaattaaatgcggggagtcggcgacctcaacctgaacccataccgtcgcgggcattgccgggcgggggcggtcggacgtccgtttcatcacaatcagcagatccagctccgcgccttttaacggcaatgtcgattcaatcaaggtaatcgcgttccacgtgccggacaacagcataataaacgtgaattcatcgcccagcatcgccagtcggctgtcttcgatattacagccgcaactgctgacatggcgagtaatggtattcacaataccgggcctgtcggcgcccagcgcagtgataaccaaatagtgttgtgatgacggtgtcaaaccagttattcctttgagcggtgaggtaatcttaaggaaaccataaaaaaaacctgcatacaacaatcagaacggctttggtcgcttgcttttattgtcataccaaacgtaccattgagggacttgtttgcacagaggatggcccatgttcacgggaagtattgtcgcgcttgttacgccgatggatgagaaaggtaacgtcagtaggtcttgcctgaaaaaactcattgattatcatgtcgccaacggtacctcggcgattgtttcggttggcaccaccggcgagtctgccacgctaagccatgatgaacatggcgatgtcgtgatgatgacgctggaactggctgacggacgtattccggttatcgctggcacgggcgcaaacgcgaccgcggaagcgattagcctgacgcagcgttttaacgatagcggcattgttggctgcctgacggtaacgccgtactacaatcgccccacgcaggaaggtttgttccagcatttcaaagccatcgcggaacacactgacttgccgcaaattctgtataatgtgccgtcccgtaccggttgcgacatgttgccggaaaccgtgggtcgtctggcggaaataaaaaatattatcgctatcaaagaggcgacagggaacttaacccgcgttcaccagatcaaagagctggtttcagacgattttattctgcttagcggcgatgacgcgtccgcgctggactttatgcaactgggtggtcatggcgtgatttccgttactgctaacgtagcggcgcgcgatatggctgacatgtgcaaactggcggcggaagggcaatttgccgaggcgcgcgctatcaaccagcgtctgatgccgttacacaacaaactatttgtcgaacccaatcctatcccggtgaaatgggcatgtaaggcattgggtcttgtggcgaccgacacgctgcgcctgccaatgacgcctatcaccgaccatggtcgtgacatcgtcaaagcagcgcttcagcatgctggcctgctgtaaagtttagggagatttgatggcttactcagtacaaaagtcgcgcctggcgaaggttgcgggtgtttcgcttgttttgctgctcgctgcctgtagttccgattcgcgctacaagcgccaggtaagcggcgatgaatcctatctggatgccgcgccgcttgctgaacttcacgccccggcaggaatgattctgccgataacgaccggcgactacgttattccggtcacgaaggggagcggcgcggttggtaaggcgttggatatccgtccgccggcgcagccgttagcgttagtgagcggcgcgcgtacccagttctctggcgataccgctacgctattggtggaaaatggccgtagcagcacgctgtggccgcaagtcgtcagcgtgattcaggcgaaaaattatccgattgaaaaacgtgacgatgccagccagaccctgacgaccgattgggtgagctggaaccgcctggatgaagacgaacagtatcgcggacgttatcaaatctcggtgaagccgcagggctatcagcaggcggtaacggtaaaactggttaatctggaacaggctggcaagccggtcgctgatgcggcgtcgctgcagcgctatagcactgaaatgatgaacgtcatttccgccggtctggataagaccgctacggatgcggcaaatgccgcgcagaaccgttccgccgcaacgatggatgtgcagagcgccgctgatgataccggtttacctatgctggtcgttcgcggtccgttcaacctcgtgtggcagcgtctcccggccgcgctggaaaaagtgggcatgaaagtcaccgacagcactcgctctcagggcagcatggcggtaacgtacaaaccgttgtctgacagcgactggcgggatctgggcgctagcgacccgggcctggcatccggagactataaattgcaggtcggcgatttagataaccgcagcagcttgcagtttatcgatcctaaggggcatactctgacgcaaagccagaacgacgcgctggttgccgtcttccaggctgcgttcaacaagtaatttaacagggctggagcaatccggcccttttttctgataagatacgcaaacgtgtgcgtcggtacaaaaacgcgatttaaccgctatttcgcaccacaattacaggccggcgtctctggcaggcgtagcaggaaatgaatacttatcgttaattcacacccaggagtgttaaagatgcaaaagcaagctgagttgtatcgtggtaaagcgaaaaccgtatacagcacggaaaacccggacctgttggtgctcgaattccgcaatgatacgtcagcaggggatggcgcgcgcattgaacagtttgatcgcaaaggcatggtaaataacaaattcaaccatttcattatgaccaaactggccgaggcgggcatcccgacccagatggaacgtttgctgtctgataccgagtgtctggtgaagaagctggagatggtgccggttgaatgtgtggtgcgcaaccgtgcggcagggtcgctggtcaagcgtctgggcgtggaagaaggcatggagcttaacccgccgatcttcgatctgttcctgaaaaacgacgcgctgcacgacccgatggtgaatagttcctactgtgaaactttcgggtgggtaagccaggaaaatctggcgcgtatgaaagagctaacctacaaagccaacgacgtactaaaaaaactgtttgatgacgcgggtcttatcctggtggatttcaaactggagtttggcctgtataaaggcgaagtggtgctgggcgatgagttttcaccggacggtagccgcctgtgggataaagagacgctggacaaaatggacaaagaccgcttccgccagagcctgggcggtctgattgaagcctatgaagccgttgcgcatcgcctgggcgtgaaattagattaattccgcttctgaccgggggggcaaccgctctccggtatcatcctttcctcattctgatagcgtttacctgtggtaatcctgcgcctgaccgcctacgatcatctgtataacaaagagagaatgaggtgattatgcgctggcaagggcgtcgtgaaagtaacaatgtagaggacagacgtaatcggccaggcggcccctcgctgggtggccctggctttcgtcttccgcgcgggaaaggcggcatcattctgttggtggtggtggtggtcgcagggtactatggggtggatttaaccggtctgttgactggtcagccggtttcgcagcagcagtcgacgcgttcgataagccccaatgatgatgaagcggcaaaatttacctcggtgattctggcgacgaccgaagatacctgggggcaactctttcaaaaaatggggcgcggctatcagcagccaaaactggtgatgtaccgtggtatgacgcgtaccggctgtggtgcgggtcagtccgtgatggggccgttttactgcccggcggacggcaccgtctatatcgatctctcattttacgatgttatgaaaaataagctgggcgcggacggtgattttgcccagggttatgttatcgcccacgaagtcggccaccacgtacaaaaactgttaggcattgagccgaaagtacgccagttacaacaaaacgcgtcgcaaacggaggtgaatcgcctttcggtgcgcatggagctacaggcggattgctttgccggcgtgtggggacacagtatgcagcagcaaggcgtactggaggcgggcgatctggaagaggcgctcaatgccgcacaggctatcggcgacgatcgcttacagcaacaggggcaggggcgcgtggtgccggatagttttacccacggcacctcagaacagcgctacagctggtttaagcgtggatttgacagcggtgacccggcgcaatgtaatacgtttggtaaaaacttttgataaactggggcagggatgtctgatatcgatgcgctacgggcgttaacgtcgcaaatgacacaggaaggcattcgccgtttactggtcatcagcggcgatgcggcgtggtgccgggaacgggccgaggcgatacgcgctgtattgcccggtgactggtgggtcgcgcctgacgcgcccgcccagccgcgctgtacgccacaggcgttacaaacgctgctgggccgtgaatttcgtcatgcgatatttgatgcctggcagggctttgacgccgcagcgtttgccgccctgagcgggaccttgcaggccggaagttggctgcttctgctgatgccgccgtatgagacgtgggaaagccggcctgataccgattcactgcgctggagcgactgcgcgcagcctatccccacaccgcagtttgcacagcatcttaaacggactctttcccgcgatccgcaaacgctgctttggcgacagcgccagccgttttgctggccatcttatccttcccgcgaacgctggcgacccgccaccggcgagccgcagccggagcaggcggctatcttatcgcgtttacgtgaaatgccgcccggcgtggcgacggtgattgccccccgtgggcgcggcaaatcggcgctggccgggcaattcatctcacagatggcgggcacggctatcgtgaccgcaccggcgaaaacggcaacggatatcctggcagcgtttgccggtgagcggttctgctttatggcgccggatgcgctgctggcgagcggggcaagagccgactggctggtggttgacgaggcggcggcaatccccgcgccgctgctgctgcaactggtttcgcgctttccccgcatactactcaccaccaccgttcagggctacgaaggcaccggacgcggttttttacttaagttttgcgcccgttttccgcagcttcaccgctttacgcttcgtcagcctgtccgctgggcgccagaatgcccgctggaaaatatcgtcagcgaggcgctgatattcgacgatgaagcgtttgcgcaggcgccgcatggcgggatagcaatctcggcattttaccagcaggcctgggggaagacgcccgcgttgccgagggctgtgtatcagttactgtcgggggcgcactatcgtacttcgccgttggatctgcgccgaatgatggatgcgccaggacagcatttcttgcaggctacggcgaataaccgtgtggcgggcgccctctggctggtcgaagagggcgggttatccgcagagctcagtcaggctgtatggtgcggtttccggcgtccgcgtggaaatctggtggcgcagtcgctggcggcgcacggtagcgaccctttagccgcgacgctggtcgggcgtcgcgtaagccgtatcgcggtgcaccccgcccgtcagcgcgaaggcatcggtcagcagttgattgcctgcgcgtgcgagcaggcggcgcagtgtgattatctttccgtcagcttcggctatacgccggagctgtggcgcttctggcaacgctgcggctttgtgctggtacggatgggcagccatcgggaggcgagcagcggttgctatacggcgatggcgttattgccgctgagcgacgcgggacaacggctggcgcaacaggaacaccgacgtttgcgccgcgatgcggatatcctgacgcagtggaacggcgaggcgataccgctggcggcgttgcgcgaacaggcgcttaatgatgaagactggcgtgagctggtcggttttgcgttcgcgcaccgcccgctactgacatcgttaggttgcctgcatcgtttactgcaatacagcgcattgccattgccggcgctgagagggcggctggaggaaaaagccagcgatgccgaactgtgcgcccggctacgcatttcaggccgtaaagctctgctggcgttgcagcgtgcgcaggcggcgcaggcgctaattgcgttggatgccggacgaacgcagcgtttgcgcgacgtaatgccaggcggtggggaccatgccggatagcgatacctgtccggcatgttatccggttactttttcggctgatctttcttcggccagtcgtcttcatcgtcccacttatcgttaaaatcgcgatgcgggggcagctcaggtttgttggcaaggaatttcttatggtcgatgcgtttgagatctttgatcacattcagcagtacgcctaccagaaacaccaataccagaatccaccaatattttgccagccagtccatgcttatttcctcttaccggaacgctcatcaggcgacgagctgttccataatacgttgatacatacgggccagtagctggagatcggcggcattcacacattcgttaattttatgaatggtggcgttcaccggccccagttctaccacctgcgctcccatacgggcgataaaacgtccgtcggacgtaccgcccgtcgtcagtaattgcggtttaatttcattatagtgctcaatggcgtttaccaccgcgtccaccagctttccgcgtgcggtcaggaacggctgaccggaaagccaccagtctacggtatagcgtagctgatgcttctcaagcagcgcatgtacccgttctttgatcatctcatcggtcagctccgtgctaaaacggaagttaaactgcacgaacagttcgccgggaatgacattattgctgccggtgcctgcctggatattggctatctgcatactggtggccgggaaaaagtcattgccccgatcccactcgatagcgaccagttcattgagaaaaggcgcggcgcgatgaacagggttatccgccagatgcggataggcaacgtgcccctgaacgccatgaatagtgaggttacaggtgagggaaccgcgacgcccgtttttgacgacatcgcccacaatttcagtactggaaggttcgccgaccagacagtaatccagccgctcgttacgggccatcagcgcttcaaccacctttacggtgccattttttgcgctggcttcttcatcagaggtaatcaaaaatgcgaggcggccccggtgatgaggatgctgtgcaacaaaacgttcagcagccaccaccatggccgccagtgaacctttcatatccgccgcgccgcgaccgaacaacattccgtcgcgaatcgtaggttcaaacggcggattgatccagcgatcgacatcgccagccggtacgacgtcagtatgcccggcgaacgccagcgtttcgccacgcccacgccatgcccaaaaattttgcgtgtcgccaaaatccatatgctcaatggtaaaaccgattttacgcaggcgttcaatcattaatgcctgacagcctacgtcatccggactcagggaggggcgacgaataagttgctgtgtcagctcaataaccgggcacgacatagactacacctcatcaaaaaactgctgataacgggattcactgaaaccaagcagcataggcttcccgggcgcgcagagcaatgggcgtttgatgattgccggctgttcaaccatgagagcagcggcggagtcggcatcggtaatcccgctgcggtggccttcatccagtttgcgccatgttgtgccgcgcgtattcagtaaaggctgccagccgagttcggcaataaaggtattaagaagagggaggtctatgccatccacacggtaatcgtgaaaacgataatcaatgccatgctcctccagccaacggcgcgcttttttgatcgtgtcgcaattcttaatgccatagagggtaatcatattgaatcctttaacgcgaaattcgaataaataatcaatagtatcgtctgcgggataataagtgtggctgttaatggttatttatccagcgctgatcggcaatcaatataacattgttgagtgaatgtgaataatgattccaaaacgttccagatgtggcttgtttataattcgtgaggaaaatcctattttgcgcacatgcaattgattgttttttaacccgatttgataaagtagtagaaaaggtattaatgttgctaaatattgcagtaagtcacataaaatttacggctacagcgccatagtaatatcatagacagcataaccagaggatatcgcaacaatcggttaaatgaacttctctctataccgctaactacgtagaatacccataataataagagaggctattatgattgaacgtgaactggggaactggggaactggggaactggggaactggggaactggggaactggggaactggggaactggggaactggggaactggaaagattttatcgaagtcatgcttcgtaaataaatgcctggaaggcaccgcgctcccataggggataagaaaaggcgactcaacgaaagtcgccttttttgtgcccgacacctcgtatcaggctggccaggagcttattccgggcgcggcttcagcgggaagcggcgacgtatcagcacgaaaaacaggggtacaaagaagatagccagaatggttgctgagatcattccccccatcacgccggttccgacagcatgttggctacccgagcctgccccggtgctggtggccatcggcaatacgccaaagataaacgccagcgaagtcatcagtatcggtcgcaggcgctggcggctggcgtacagcgtggcgtctaacagcgcgtgtcccttctgattcatttcgttggcgaattccacaatcagaatcgcgtttttcgccgagaggccgataacggtcaacagccccacctggaagtaaacatcgttttccagcccgcgcatccaggtggcgagtaacgcgccgatgaccccgagcggcacaaccagcatcaccgagaagggcaccgaccagctttcatacaatgccgccagacacaggaagacgactaatagcgaaatagcgtacagcgcaggcgcctgcgcgccggagagccgttcctggtaagacatggctgtccattccaggccaaaaccgcccggtagctgatgcaccaacgactccatgacatccatcgccgtcccggtactgacccccggcgcggcctctccgacaatttctaccgccgaatagccgttatagcgttccagacgcggcgatccggtttcccagcgcgaggtggcgaaggcggagaaggggaccatgccgccgtctttgttacggacataccaaagattaatatcgtccggcaacatacgatatttcgctgcggcctgaacatagaccttcttcacgcggccccggtccataaagtcgttgacgtagctcgatccccaggctgtttgcagggtgtcgttgatatcgtcaatcgatacgcccagcgcctgcgctttccgttggtcaatatcaatttgcagttgcgggctgtcgtccaggccgttgtggcgcacgcgggtcaaggaactgtttttcccggccagctcaatgagttgatctcgtgcggccatcagcgcgtcatggcctgctccggcgtgatcctgtaattccatatcaaaaccggcggagctgcccagaccgctaattgccggcgggctgctggcgaagacgcgagcttctttaatctggttaaatgcttttgtcgcccgctcaataatggcgaacgaggagccggtggtgggatcgcgcgcgtcccagtctttcaagcgaacaaacatacgcgcgacgttttgcccgttcccgccagggccggaaccgaccgtcgagaagaccgacataatgttgtttttctcatgggtgaagtaatagttttcaaccttttcaacgactttcagggtctgctgttgcgtagagccgctcggtagctggatagacgtagtgaacatgccccgatcttcttgcggcagaaaggaggtggggagacgcaaaaacaggaacaccatgccgccaagcaacagaacataaatcagaatccagcgcaggctgcgatgcaaaattttcgctacgcctttctcataacgttcggcattacgattgaaggtacggttaaaccagccgaaaaatccgcgttgcccgtgctgttcgcctttgtgcagcggttttaataacgttgcgcacagcgccggcgtcaggatcatggcgaccagcaccgacagcaccattgccgagacaatggtgatagaaaactgacgataaatcgccccggtggtaccgccaaagaacgccatcggtacgaataccgcagacagtaccatcgcgataccgaccagcgccccctggatttgtcccatggatttgcgcgtcgcttcacgcggcgtgagcccttcttcgctcatgatacgttcgacgttttccaccaccacgatggcatcgtcgaccaggagcccgatcgccagcaccatcgcgaacatggttaatgtgttaatactgtagccgaacgcgtaaagcacggagaaggtgcccattaatactactggcacggcgatcgtcggaatgagcgtggcgcgaaagttttgcaggaacagatacatcaccaggaaaaccagcgcgatagcttccagcaacgttttgaccacatcgataatcgaggctttgacaaaggaggtggtttcatacgcgatcttgtattccaggccgtgagggaagtactgcgccagctcgttgaggcgatccagtaccagcttcgcggtcgccatttcgttcgcgccggaggccagcttaacgccaaggccggaagccggattgccgttaaaacggctgaggtagtcatatttttccgcccccagctccacggtggcgacatcgcccagtttgacctcggaaccgtcctgattaacgcgcagggtgatatcgcgaaattgttgcggcgtttgcagcagcgactgcgcattgatggtggcgttcagcgcctgcttgtcgaccgaaggcgtaccgccaagctgcccgacggcgatttgcgcattctgcgactcaatcgcatcggtcacgtctttcgtggtcatctgaaaactattcaatttggccggatcgagccagatacgcatagagtactgtgaaccataagcgtcaatatcgcccacgccgttgacgcggctgagcgggtcctgaatattactggcgacgtagtcggcgatatcctgcttgtccatagaaccgtcggtagagacgaaagcgatggtcaaaatattggtatcgcccgttttgcgtaccgtgacgccttgatcctgtaccgcctgcggcagtttacgcatcgcggactgtaactggttttgcacctgctgaaccgcctcatcaggatcggttcccgcaatgaagctcagcgtaatggtcgcctgtccggttccgctgctttgtgatgacatgtacatcagattatcgaggcccgtcatattctgctcaataacctgggttacggtattttccagcgtttgcgccgacgctcccggataattcgcggtaatacgtacgttgggcggcgccagatcgggatattgttcaacaggtaaagaaaaaatggctaacgcccctgtcagacacaacaggatagccagcacccaggcaaaaatggggcgatcgataaaaaaattcgccattaaaggggaacctcgtgtttctacatatcgttatagatttgaactgcttcactgtagcggcaagctacgagccaaacgtggagaaataaaggagataatgtaaattatcatgcgcttttacagcatactttttgtgccaacgccggaaagcctgacatctggccttccggtgatttgccgttctttacgttaactgactctcttccttgttggaggagcgaaaactgatactgaccagcgtgccgccgccggagggttgcgaaaaattcagcgtgccgccaagccgttccgcgcgctcacgcattatattcagaccatagtgtccggcaggctcatgcggttcgccgataccaatgccattatcgcgaatataaacggtatgatcgccgtcaggcgcggtgacgcagctcacggcgatttcgctcgcgttggcgtgtttaatggcgttcaggacagcttcacgcacaatttgcaataaatgcacctgcatttgcgcatccagcgccagcgtgggtaaacggcaatccaacttgagtttagccggagtctgactctgtaaatcttccagcatctcatgcaatgcggagggtaaatcggcctgctgtaacgtcagacggaacgtggtgagtagctcgcgaagctgacggtaggcgtcgttcagcgctctggaaaaatccgccatgatgctttgcgcgccggcgttatcttctggaatggcgcgcttcaaaagcgttaattgaatacgtaaataagaaagtacctgcgccagcgaatcgtgtaactcacgggcaatcgtcgcgcgctcttccattaacaaaagttgctggaagtgtttttgcgcctgattaaagtacaaaccacgccccagcatcgtggagacgctgttcagcaacggcgtagaggcattaacgttggggctttgccagtggagttcgccatagaccgtgtcctgcatcgtcactggcagcatttgcatcggcaggtcggggctttgcgtgccttcgctaatccgccagttatcgcccacggttaactccagataccaggcggcgtcatgttcacggacaatttgcaaaatatggcgaaaacagtggacatcgatttggctggtattcagcgcctgggagcactggtataacacctccaggcggcggtgcgcttcgtgcagatcgtgcgttttttcttccaccgaggcttccagcgaacgataaagtttatgcagctcgctcgacatctgactaaacgttttcgccaacaatcccagctcattgggtaagctggtatccagcggcagcggggcgaactgaccatgttcaattcgctgactggcggtgaccagttgattcagcgggcgaacgacctgctggcgaatacgccgtagggtaaaaaagaccagcgtaaatatgccgataccgcccgccagcgatatggcgacgaccagcatgactttacgctcggcgtaatgctgtaacgccagaacgaagagatcaatttgatcgacgtaattgttgatattggactgataccagacaatgtcgccatcctgtaggcggctattcatctccagccagttggcgtgcaggcgcgcgtagcgagttttcaccgcctgcggcacataccaggcgttgagattttgcagtaccggcgagttgagcgcgtgctggaaaagttgacgatgcgcattaatctgcgggctacggctttgcagatcgtaacccagccgatagctctgcattcgtagcgaaccggcgatattgatcgcttcggcatcccgtaaactgctggtcagcgtcagtaatgcgctgccggtggacagaatagacaacagcacaatatagaaaaaagccttagccagactggccgagaccgggcgtttaaccgtcacactggtactccccgcatttagctgaaccgcaatttcatttgctttgaaataaattgatctgccacaggttctggacagatagttgtgcttcctgggcagatgaacattgccgaccccgccttcgtcagttaataacaatgctcatataaagaataaggtttttgcaaccaaaacagaaggacgccatgaatcgttttattatggccaatagccagcagtgtctgggatgccatgcctgcgaggtcgcctgcgtaatggctcacaatgatgagcgacatgttctgacgccacagcgctatcagccccgaattactgtcatcaaacatcagcgccagcgcagcgcggttacatgtcaccattgcgaagatgcgccctgcgcccgtagctgtccgaacggcgcgatcgcgcatattaacgacagcgtgcaggtcaatgcgcagaagtgcatcggctgtaagtcctgcgtcgtcgcctgcccattcggcaccatgcagatggtattgacgcccgtcgcgccaaaccagttcaaagccagcgcgcataaatgcgatctgtgtcagggacgtgaacagggtccggcctgtgtggaaaattgcccggcggatgcgctgcaactggtcaccgaagactcgttgacccgtctggctaaaacgcgacggctgcgtaccgcccggcaggagattcgcccctggcataccgtggatacacaacacagtgggacagcatgcagcaaagtcgagcgtatgcaggcgacgccgccgcgcggcgaaccggataaactggcgattgaagcgcgtaaaaccacctttgaggaaatttatctgccgtttcgcgccgcgcaggcggagcgtgaagcggcccgctgcctcacatgcggggaacacagtatctgcgaatggacctgtccgctgcataaccatattccccagtggatcgaactggtgaaagccggcgatattgatgcggcggtagagctttcccaccagaccaactgtctgccggaaattaccgggcgcgtctgtccgcaggatcggctatgcgaaggcgcgtgtacactccgcgatgagtatggcgcggttaccatcggcaacattgagcgctatatctccgatcgcgctctgagcaaaggctggcgtcccgacctgtcggacgtacagaagagcgataagcgcgtggcgattatcggcgcggggccggcaggtcttgcctgcgctgacgtgctggcgcgccgtcgggaaatcttcagcgcgatggggattcgtttcgaacttaactgcgaagtagggaaagatatttctctggagacgctgctggagagttatgacgccgtctttgtcggggtaggaacctatcgttccatgaaggctgatttaccgaatgaagacgcgccgggggtatatgatgcgttgccattcctcatcgccaataccaaacaggtgatggggcttccggcgttgcctgacgagccgtttattgatactgcgggccttaacgtggttgtgctgggcggcggtgacaccgcaatggactgcgtacgtacggcgttgcgtcatggcgctgccaacgtcacctgcgcttatcgccgcgatgaggccaatatgccagggtcgaaaaaagaggtgaaaaacgcgcgggaagagggcgcgaactttgaatttaacgttcagccagttgagttggtgctggatacgcacgggcgcgccagcggtattcgctttttgcgtacgcggcttggcgaaccggatggtcaggggcgacgccgtccggtacctgtaccggacagcgagttcgtgatgccggcggatgcggtcattatggcgtttggttttcatccgcatggtatgtcgtggctggaatcgcatggcgtgaaggtggataactggggacgtattgccgccagcgtcgagagcgagtttcgttaccagacgtccaacccgaaaattttcgctggcggcgatgcggtgcgcggcgccgatctggtggtgacggcgatggcagaaggccgacatgccgcgcaggggatactcgactggttagctaaataagcgtatttgtaggccggttaaggcctggaacggttaaatgatttagtgataaaaaatcttaaacttattggctaaccttactccgtttgcagaaatgttgacgctcgcagggctggacgccctgcgataaacattttcccgctgggtcgatgtttaacaggcctgataaggtcaatcttagtattgaaaatagagtgtaaattgaaggaagggacgctatcagaatcccttcttagagcctatcccattagggctattttacgtgccattttggacctgggcagtgctcgccaaaacgcgttagcgttttgaacgccgcttgcggcggcccgaaggacgagcgtagcgagtcaaacctcacatactacgtgtacgctccggtttttgcgcgctgtccgtgtccaaactggctgcgccaataacgtctggtgggataggctcttaatttttattttaaggaaccatatatctggtcaacaatccagccatacgtcgccgcaggtaataatccactgacaaaaacattcgggttcactttaggatttgctaccggcgagtgcggcctgttacctaaaataacaatcgccatatgattaaccggatcgatagacgtcagcgttccggtccatccggtatgtccatacgtttgcggactggctaataccccgaacgttggggtcattgaggcgttgccgttaacgcgccaccccagaccaaaggtagcatcttctggcgagcggcgagtaaactgcgcaaccgttttgttgtcgaatagcttcacgttaccgtagccgcccccattgagcatgacttgcattaacacagccatatcatgggtgtcagaaaacagtccggcgtgtcctgaaacgccgcccattgagtaccaggctttttcgtcatgcacctggccccatagtgtattggtgcgaatattggggaaatgaatcacgccgtcacgcgtgttgccgtgtagttccgttgcggcgatttgcggcggcgtgaagcctttcatcagcgggttaaagacggtatgttttaatccgagcggtttataaatggtggtttcgacgtagcgatctaatggcattgccgttatcgattcaatgataaaaccaagaatcatataatccacgtcgctgtagatatgcttcgacccaggttgatattccagcggtgtctttttaatcatctccagagtagtgcttttactctgtgaaaataatttaccggcgacgtttttattgggatattgtgggtcggcaggaaagcccgcgacgtgatgaagaatatcaataatgcggagtttatctttgccttttattttatccccaggcatatccttaaagccggggatatattttgataccaaatcattgacatctatttttccttcatacaccagtttttgcaatgcaaagttagtggcatacatttttgtgtttgaagccaggtcatacatcgtgttagtggtcgcccgaatgggatgggctaacagcgtggaaccgtcatattttttggcatagccccaggctttttgtagaacaatatgattatcttttatcaccagaagattgatgctgggatatccggcatcaatttgattttgaatccagccatcaagtcggtgaagtttttggctatcaaaccccacctgatcagggctcgcggtggtcaataccggatactcaacggcaaaagctgaaagggaaaacgtcagtagaaccgtcgcaacgagagtaaatttcatgatgattccctcagtctcactccggccgtcaaatcatatcgcgagcatggactctgcggcccggagaagcagaatgtggtcatggcagtgacagaaaaatatggctgtacatccgttcagtcggcattaaggattaacccttcagcagacaaaaccgacctcacggcgtaatattaatgctctttttacaccctggagccagcatgtcgcaaaccattacgcttattaaggataaaattctttctgataattattttactctgcgcaacattacctatgacctgacccgtcgtaatggcgaggttatccgtcacaagcgtgaggtttacgatcgcgggaatggcgcaaccattctgctttacaactcaactaaaaaaaccgtggttctggttcgccagtttcgcgtggcgacatgggtcaatggtaatcaagacggtatgttaattgaaacctgcgctggcctgcttgataacgacgagccggaggtctgtatccgtaaagaggccattgaagagacagggtatgacgttggtgaggtacgcaagatatttgagctgtatatgtcgccaggcggcgtcacggagctgattcatttcttcattgccgaatatcatgatagcgagcgtgccagcatcggcggcggcgtggaggacgaagagattgaggtgcttgaactaccgttttcccgggcgctggaaatggtgcgctcaggcgagattcgggacggtaagaccgtgttattgcttaactatttacagacgtctcatctaatggactgaaaaaaaagaaatatatttctttacacaaaaaagaccaatccgataaatctgattgagaaccctgaggcgcgcaaggaagataccgcctgagctgtgttgttctgaatctggggttgttccgttcatgcgctaccgcgttattcttttttgtctgtttggcctgttgccggtccagctactgtgggctgcgccagcgcaacggactttttccgactggcaggtcacctgcaataaccaaaatttttgcgtagcgcgcaatactggcgaacatcatgggctggtgatgacattaagccgcagcgccggggcgcgtaccgatgcggtactgcgtatcgaccgcggcggtttggcgccgcccgacgctaaagaagccgcaattgcgcctcgcttattgctggatggcaaaccgctttcgttcaacagttcacactggcgcgtgtcgccctggcatctcatgaccggcgatcctgccaccatcaccgcatttttacagacgattcaggatgcgcaggccatcaccttaaaaaacggcgttcagacgctttcgctggcgggattaaaagcggcattactgtttatcgacgcgcaacaaaaacgtgtgggcagcgaaaccgcctggattgaaaaaggaaacgaaccgccgctcagcgtgcccccggcaccggcattaaaggggatcgccgttattaatccaacgcccgtaccgctgagtgaggaagaacgcgacgatctgctggactacgccgcatggcgggtaaacggcattcgttgttcgcttgacccgctgcgtcgcgagacgcaggtcagcgcgttgacggatgataaagcgttattgattgttaactgcgaagccggcgcctataacactattgatctcgcctgggtagtttcacgcaaaaaaacgctcgtctcgcgcgccgtacgtttgcggctgccgtttaatcgcggcgtcgaaagtaatgacatggagttgatgaacgccttctttgacgagaaaacgcgcgagctggtgacgttggcgaaagggcgggggttaaccgactgtggtatccagacgcgctggcgctatgatggcgatcgttttcgtctggtacgttatgccgaagaaccgagctgcgatagctggcacgggccggatgcctggcctacgctgtggatcacgcgttgaatcctggttgttatccccttttcagaatagggatacacctattgaggtttcatttatggtatagagattgctacgttacggtaggattgttactttacccgatagcctcaccacagcaggaaatagtatgaaaataaataatggccccgtattatgcccccattgtggctgcctgagcgcttattatgaaatagatcggctggcggcgataagagaaaaagtgaataaagaaggcggatcagcggcgtgggattcaacattgcaggcgcataaaaaaaaggccttttgcctgatgtgccataaatccattgatgaggtcgtcatcgggcagtcagatgcgcctgagtctacgaagtaattttgcacagcctacagaacaggtctgcagactgtgcaaagtctgtgttgctaacgcccgccttagcctttgatgttcagcacccggcgggctttttccacaatattttccacggtaaagccaaaatacgggaacagtttgtcagccggggcggattcaccgtatcccgtcatgccgataattgcgccttttaggccaacatatttataccagtagtcggctataccggcctccaccgcgacgcgggcggttacgtgcgccggtagcactgattcgcgatatgcctcgtcctgcgcatcgaaaatatccgttgaaggcaacgacaccacccgaacgttatgcccctcgccagtcaatttttccgccgcctggagggtaatttccatttccgatccggtagcgatcagaatgatatccggcttgccgccgctatctttcagaatataaccgccgcgggcaatcgctttcacctgttccggcgtgcgttccacctgcgccagattctgccgcgagagaatcaacgccgtcggcccgtgctgacgttcaatggccagcttccaaccgactgccgcctcaacctgatcgcagggacgccaggtgctgaagttaggcgttaagcgcaggctcgccagttgttccatggcctggtgcgtcgggccatcttcgcccaaaccgatggagtcgtgggtatagaccataatctgccgggctttcattaaggccgccatacgcgccgcgttacgcgcatattcgacaaacatcagaaacgtggcggtatacggtacaaagccgccgtggtgggcgatgccgttggcaatggcggtcatgccgaattcgcgcacgccatagtggatgtaattacctgccggatcctctttcaacgaggtcaaacctttccagatagtcaggttgctcggcgccagatccgccgatccgcccaacagttccggcaacaggggaccataggcattgagcgtattttgcgatgctttacgggtggcgattttggccggattagcctgcaagtcgttaataaatttttgcgtggcggattcccatgcctccggcaatccgccgctcatccggcgggtaaactccgcggccagctcaggataagccttctcataagcagcaaacttttcctgccactgctgctgcgctttctcgcctttttcacggccatcccacgcgcggtaaatctcttttgggatctcaaacgccggatgatgccatcccagcttctggcgggtcagcgccacctcttcttcgcccagcgccgcgccgtgcgactcctccttcccggctttattcggcgagccaaaacctatcaccgtccgacagataattagcgaaggtttatcttttacgctctgggcttccagaatggcttttttcaccgcctccggagcgtgcccgtcaatgtcatgcacgacatgccagtggtaggcttcaaaacgtttggctgtatcgtcggtaaaccagccttcggtttcgccatcaatggagatgccgttgtgatcgtaaaagccgatcagtttgcccagtcccagcgtaccagccagcgaacacacctcatgcgagatcccctccatcagacagccgtcgcccataaagacataggtgtagtggtcgacaatctcatggtccggccggttgaactgtgcgcctaacgtacgctcggcaatcgccagcccgacggcattcgccagcccctggcccagcggcccggtggtggtttcaacgccaggcgtatagccaatctccgggtgaccaggcgttttagagtgcagttgacggaagttttttagctcctccagcggcaggtcatacccggttaaatgcagcagactatagagcagcatggaggcgtgactgttggaaaggataaaacgatcacggtcataccaggtcggatcggtggggttatgtttaagaaaatcgttccatagcacttcagcgatatccgccatccccatcggcgcgccggggtgcccggaattggctttttgaacggcatccatgctcagcgcacgaatcgcattggcaaggtctttacgggacataaatcactccatgcaaggtttatagtttggcggcaagcaggtcttccagtttgcgctggtcaacggcgaaaaggcggataccttccgacagcttctctacggccatcgcgtcctgattatgttcccagcggaactccgcttccgtcattggcgtaggacggtggaacatctgcgaggaaggcaccagtttacggatcaccggttcttctttttctttcagctctttaagcaggttaggggagatagtcagtcgatcgcagccggttagcgcgaggatttgctcagtacggcggaaacttgcacccatcacgatggtttcatagcgatgctgtttaaagtaatcgtagatattgcgtaccgatttcacgccgggatcttcctccacgacatacggctccagcggactacgcgcctgataccagtcgtaaattcggcccacgaacggagagattaaatagacgcccgcttcggcgcaggcgcgcgcctgggcaaaagagaacaacaacgtcaggttgcaattaatgccttctttttcgagctgttcggcggcgcgaataccttcccaggtcgcggcgagcttgatcagaatgcgtgatttatcaacatcctgctgctggtagagatccaccagatggcgtgctttctcgatacttttttctttatcgaacgataaccgcacgtcgacttcagtggagacgcgaccgggaatacttttcagtatttccgcgccaaaattaaccgccagtttatcgctggctgccgcaacctgctgttcctgcgtaccgccgtgtttttttccccaggcaatcgcatcctcaatcaaatgaccatactgctcaagcccggcggcttttaacagtaaagagggatttgtcgtggcatcctgcggctggtagtggcggatggactcgatgtcgccgctgtcggcgacgacggtagtgaattgtttgatgccgtctagctggttcataggaaatactccttgaaaagtaaagtgttagatgagtgtgttgattcacacttctgaaagattgatacactacataaccaaaaagcatagcagacaggcatggtattgctggtataagcaggtaacatggctgttataagttgataacaaactcttgcgccgcgtcgtgatagtttgcagaccttcaaagtttgtgttgcgcagtacggtgataatgtgcggcgcaccaggccgcgtcactttttgaacgatacgtgaaaggaacaacaaaatggatgagcagttaaaacaaagcgcccttgatttccacgaatttccggtacccggtaaaattcaggtttctccgactaagccccttgccacccaacgcgatctggcgttggcttactcgccaggcgtggcggcgccctgcctggaaatcgaaaaagatccgctggcagcctacaaatacaccgcgcgcggcaaccttgtcgcggtcatttccaacggtacagcggtgctggggttaggcaacatcggcgcgctggccggcaagccggtcatggaaggcaaaggcgttctgtttaaaaaattcgccggcatcgatgtgtttgacattgaagtcgatgagcttgatccggacaaatttatcaatgtggtcgcagcgctggagccgacctttggcggcattaacctcgaagacattaaagcgccggaatgtttctatattgagcagaaactgcgcgagcgcatgaacatcccggttttccatgacgatcagcacggaacggcgatcatcagtacggccgccattcttaatggcctgcgagtcgtagagaaaaatatttccgacgtgcggatggtcgtctccggcgcaggggcggcggcaatcgcttgtatgaacctgctggtcgcgttggggatgcagaagcacaacatcgtggtgtgcgactctaagggcgttatttacaaaggccgtgagccgaatatggcggagaccaaagcggcctatgcggtagacgacagcggcaagcgcacgctggatgaggtcattgacggcgcggatattttcctcggctgttcaggcccgaaagtgctgactcaggagatggtgaagaaaatggcccgcgcgccaatgattctggcgctggctaacccggaaccggaaattctgccgccgctggcgaaagaagtgcgtccggacgccatcatctgtaccggtcgttccgactatccgaaccaggtgaacaacgtattgtgcttcccgtttatcttccgcggcgcactggacgtcggcgcgacggcgatcaacgaagagatgaaactggcggcggtccgtgcgattgccgagctggcgcacgccgaacagagcgaagtggtggcctcggcctatggcgatcaggacctgagctttgggccggaatacattattccgaaaccgtttgacccgcgtctgattgtcaaaatcgctccggcggtcgcgaaagcggcaatggattccggcgtggcgacgcgcccgattgctgactttgatgcctatatcgataaactgaccgagtttgtctacaaaactaacctgttcatgaagccgatcttctcgcaggcacgcaaagatccgaagcgcgtagtgctgccggaaggggaagaggcgcgcgtgctgcacgcaacccaggagttgataaccctggggctggcgaagcccatcctgatcgggcgtccgagcgtgatcgaaatgcgtatccagaaactggggttacagatcaaagcgggcgttgatttcgagatcgtgaataatgaatccgatccgcgcttcaaagagtactggagcgagtattaccagatcatgaagcgtcgcggggtaactcaggaacaggcgcagcgtgcgatgatcggcaaccatacggccattggcgcgatcatggtgcagcgtggagaagcggatgcgatgatctgcggcaccatcggcgactaccatgagcatttcagcgtcgtgaaagccgtctttggctaccgtgacggcgtgcatacggcaggggcgatgaacgccttactgctgccaagcggcaacacttttatcgccgatacttatgttaacgaagatcccacgccggaacagttggcggagatcgccgtaatggcggcggaaaccgttcgccgctttggtattgagccgaaagtcgcgctgttgtcgcactctaactttggttcctcaaattcgctgtccgccagcaaaatgcgcgaaacccttgagcgggtacgcgaacgagcgcccgatctgatgattgacggtgagatgcacggtgatgcggcgttggtggaaagtattcgtaatgaccggatgccggatagtccgctgaagggagccgccaatattctggtgatgccgaatatggaagccgcccgcattagttacaacttactccgcgtctccagttccgaaggcgtcacggtcggcccggtcctgatgggcgtgtctaaaccggtacatgtattaacgccgatcgcctctgtacgccgtatcgtgaatatggtggcgttagcggtagttgaagcgcaaaccacgccgctttaataacgcattactctctcttctggcgcaggttctcctgcgcttttttgtctatggaaaacccccagctaggctgggggttccggaaagctttcagctttaagccagttattaaaaccccttttgatttgttaaaacatcttgcggtctggcaactgcaaaagttcaacaagaaatcaaaagggggtccaatgagggacgaaaagagcttagcgcacacccgatggaactgtaaatatcacatagttttcgcgcccaaataccgaagacaagcgttctatggagagaagcgtagggcagtaggcagcatattaagaaaattgtgtgaatggaaaaacgtacgaattctggaagcagaatgttgtgcagatcatatttacatgcttctggagatcccgccgaagatgagtgtgtcgagtttcatgggatatctgaagggtaaaagtagtctgatgctttacgagcagtttggggatctaaaattcaaatacaggaacagggagttctggtgcagagggtactatgtcgatacggtgggtaagaatacggcgaagatacaggactacataaagcaccagcttgaagaggataaaatgggtgagcaattatcgatcccgtatccgggcagcccgtttacgggccgtaagtaacgaagtttgatgcaaatgtcagatcgtatgcgcctgttagggcgcggctggtaagagagccttacaggcgcatcagaaaaacctccggctatgccggaggatatttattttatgcgccgctgggcttcgccatggtatgaaaggctcgggtggggatattctggaacctattgcgttacccctacttatttcactgaatctgtactatgcacaaatcgagtgatacgcattatttttatcaataatagtaatacaaagaatagccggtgggtatttattgcggaacaagcttaaattcagaatgacgcctgaaaatgtgatgcaccacgatatttatcgttaacaccttcgacagaagtcccttttattttctttctcttagtgatctacctcaccttttacatcaccttgccgaattttgttatttactccgacaaaaaattgccacgatgacggcagtttcagtggagacggtgagcaatgaataaagaacgcattattcaggaatttgtgccgggcaaacaggtcacgctggcgcatctcattgcgcaccctggtgaagaactggcgaaaaagatcggcgttcccgatgctggcgcgattggcattatgaccttaacgccgggggaaacggccatgatcgctggcgatttagcgatgaaggctgcggatgtacacatcggttttctcgacagatttagcggcgcgctggtgatttatggcaccgtcggcgcagtagaagaagcgctattacagacggtcagcgggctggggcgattattaaacttcaccctgtgtgagttaacaaaaagttaattggtggcggtaatgaaacgtattgcttttgtcggcgcggtcggcgccggaaagacaacgctttttaacgcgttacggggaaattattccctcgccagaaaaacgcaggccgtggaatttaatgatcatggcgatatcgatacgccgggtgaatattttagccatccccgttggtatcacgccttaattaccacgttgcaggatgtggacacgctgatttatgtccacgcggcaaacgataaagaaagtcgcttacctgccgggttattggatgttggaacccgtaaacgacatatcgccgttatcagcaaaacggacatgccggatgccgacgtcgccgctacgcggcagttgctttgcgagattggattccgggagccgattttcgagctcaacggccacgacccgcaaagcgtgcggcagttggtggattatctggcggctctcagtgaacaggaggaagaggcaggtgaaaaaacttatcacagctaacgatattcgtgcggcccacgcccgcggcgaacaggcgatgtcggtagtgctgcgcgccagcattattaccccggaggctcgcgaagtggcggaactactgggcttcacgattaccgaatgcgacgagtccgtcccggcatccacatcggcgcaggcgtgtaaaagcgaaagccagcgcattcgggaagccatcatcgcgcagcgcccggaagggcagtttactgaaagcctggtggcgcagttgatggaaaaagtgctcaaggaaaagcagtcgctggaactggggacgatgcagccgagctttacctccgtcacgggtaaaggcggcgtgaaagtcattgacggcagcagcgtgaaatttggccgcttcgacggcgccgaaccgcactgcgtcggcttaaccgatctggttacagagcaggatggcagcagcatggccgccgggtttatgcagtgggacaacgcctttttcccgtggacgctgaactacgacgaaatcgacatggtgctggagggtgaactgcacgtacgccatgaaggcgaaaccatgattgccaaagccggagatgtcatgttcatccctaaaggctccagcattgaatttggcacgccaacgtccgtgcgctttctgtacgtcgcctggcctgcaaactggcaatccgtatgaacgatttcatcaccgaaacgtggctcagagcgaatcatacgctcagcgaaggatcggaaatccatctgcccgctgacgcacgactgacgccctcggcccgggaactgctggaaagtcgtcgcctgcgcattaagtttctggatcagcaaggccggctgtttgtcgatgatgacgaacagcagccggtacatggcttaaccagtagcgatacgcacccacaggcctgctgtgaactgtgccgccagccggtggtgaaaaagcccgatacgctgacccatctgacggcggacaaaatggtcgccaaaagcgacccgcgcctcggctttcgcgccgcgctcgacagcgccatcgcgctgaccgtgtggctacaaatcgaactggcggaaccctggcagccgtggcttttcgatatccgctcgcggctgggcaacattatgcgcgccgacgctatagatgaaccgctggcggcgcagtctatcgtcgggctgaacgaggatgagctgcatcggctttcccaccagccgctgcgctatctcgaccacgatcacctggtgccggaggccagccacggtcgcgatgcggcgctgcttaatctgctgcgaaccaaagtccgcgaaacggaaaccctcgccgcacaagtgtttattacccgtagttttgaggtcttgcgcccggacattttacaggcgctaaaccgtctctccagcacggtttacgtgatgatgattttgagcgtggcgaaacatccgctgacggtcgcccaaattcaacaacggttgggagagaagccatgatcattgaacgcgcccgcgaactggcggtacgcgcccccgccagagtcgtctttcccgatgcgctggacgaacgcgtgctgaaagcggcgcattacctgcaacagtgcggtctggctcgccccgttctggtcgccagtccgtttgcgctgcgtcagtttgccctgagtcatcgtatggcgatggatggcattcaggtcatcgacccacacagcaacctgagtatgcgccagcgttttgcgcaacgctggcttgcccgtgccggagaaaaaacgccgccggacgcagtggaaaagcttagcgacccgctaatgttcgctgccgccatggtgagcgccggtgaggctgatgtgtgtatcgcaggcaacctgtcgtcaacggcgaacgtgctgcgcgcagggctgcgggtgattggcctgcaacccgggtgcaaaacattatcgtctattttcctgatgctgccgcagtatgccggcccggcattagggttcgccgattgcagcgtagtgccgcagccgacggcggcgcagctggcggatatcgctatcgccagcgccgacacctggcgggccattaccggcgaagagccgcgcgtggcgatgctgtcattttcaagcaacggcagcgcccgtcaccccaatgttgccaacgtgcagcaggcgacagagttcgttcgcgaacgtgcgccgcaactgcttgtggacggtgaattgcagtttgacgccgctttcgtaccggaggtcgccgcgcaaaaagcgcctgacagcccgctgcaaggccgcgccaacgtgatgattttcccgtcgctggaggcgggcaatattggctacaaaatcgctcagcgtctgggaggctatcgcgctgttgggccgctaattcaggggcttgccgcgccgcttcacgacctctcccgaggctgtagcgtgcaggaaattatcgaactggcgttggtggcagccgtgccgcgccaggctgacgtgagccgcgaacgcagcttacacacactggttgaatgaacggtcccgttctggacccctttaatgagaggaaaacacgatggaagcattaggaatgattgaaacccggggcctagttgcgctgattgaggcctcagatgcgatggtaaaagccgcacgcgtgaagctggtcggtgtgaagcagattggcggtggcctgtgtacggccatggtgcgtggcgacgtggcggcgtgcaaagccgcaaccgatgctggcgccgctgcggcgcagcgcattggcgagctggtctctgtacacgtgattccacgcccgcacggcgatctggaagaagtgttcccgatcagcttcaaaggcgcagcaacatttgatggtaggccggataagacgcgcagcggcgccatccggcatgaatgcgcgccattgcctgatagtgcgcagattcaaggcctacgacccaacgggcaatccatggaggcggatatgaaactggcagtcgtcacaggacaaatcgtatgtaccgtccgccatcagggactggcgcatgacaaattgctgatggtggaaatgatcgatgcccagggcaaccccgacgggcagtgtgccgtcgctatcgacagtatcggggcgggaaccggagagtgggtactgctggtcagcggcagttccgcgcgccaggcgcatcgcagcgaattatcaccggtcgatctgtgcgtcattggcatcgtcgatgaagtggtggctggcgggaaagtggttttccataaataggactgaacatcatgaatcaacaggatattgaacaggtggtgaaagcggtgctgctgaaaatgaaagacagcagccagccggccagcactgttcatgagatgggcgtttttgcctccctggatgacgaagtggcggcagcaaaacgggcccagcaggggctgaagagcgtggcgatgcgccagcttgccattcatgccattcgcgaggcgggcgaaaaacacgcccgagaattagcggaacttgccgtcagcgaaaccggcatgggacgcgttgacgataaatttgccaaaaacgtggcgcaggcgcgcggcacgccgggcgtcgagtgtttatctccgcaggtgctgaccggcgataacggcctgacattgattgaaaatgcgccgtggggcgtggtggcctcggtcacgccgtccaccaatccggcggcgacggtgatcaataacgccatcagcctgattgccgcaggcaacagcgtcgtgtttgccccgcatccggcggcgaaaaaggtctctcagcgggcaatcaccctcctcaatcaggcggtggtcgccgccggcggcccggaaaatctgctggtcaccgtggcgaacccggatatcgaaaccgcccagcggctgttcaagtaccccggtattggcctgctggtggtgaccggcggcgaagcggtggtggacgcggcgcgcaaacatactaataaacgcctgatcgccgccggtgccggcaatcccccggtggtggtggatgagaccgccgacctgccgcgcgccgcacaatccatcgtcaaaggcgcgtcgtttgataacaacatcatctgtgccgacgaaaaagtgctgattgtggtggatagcgtcgccgacgagctgatgcgtctgatggaaggtcagcacgcggtgaaactgactgccgctcaggccgaacagctccagccggtgctgctgaagaatattgatgagcgcggcaaaggcaccgtcagccgtgactgggtcggtcgtgacgcgggcaaaatcgccgcagccattggcctgaacgtcccggatcaaacgcgcctgctatttgtggaaacgccagctaaccatccgtttgccgtcactgaaatgatgatgccggtactgccggtggtgcgggtcgccaacgtcgaagatgccatcgccctggcggtacaacttgaaggcggttgccaccatacggcggcgatgcactcgcgcaatatcgacaacatgaaccagatggcgaacgccatcgacaccagcattttcgtcaaaaacgggccgtgcattgccgggcttggattgggcggagaaggctggaccaccatgactatcactacgccaaccggcgaaggggtgaccagcgcgcgtacctttgtgcggctgcgtcgatgcgtgctggtggatgcgtttcgcattgtataagggatgactcatggcgcacgacgaacaactctggctcaccccaagactgcaaaaagcggcggccctgtgtaaccagacgcccgccgccagcgacacaccgctgtggctgggcgtcgatttgggcacctgcgacgtggtgtcgatggtggtcgacggcaacgcccagccggtggcggtgtgccttgactgggccgacgttgtgcgtgacggcatcgtctgggatttcttcggcgccgtcaccctcgtgcgccgccatctcgacacccttgaacagcagctcggctgccgctttacccacgcggcgacctcgttcccaccgggcaccgacccgcgtatttcgatcaacgtgctggagtctgctgggttagaagtcagccacgtactggatgaaccgacggcggtggcggatctgctggcgcttgataatgcaggcgtggtggatattggcggcggcactaccggcattgccatcgtcaaacagggcaaggtgacttactccgccgatgaagccactggcgggcaccatatctccctgacgctggcgggcaaccgccgtattcccctagaagaggcggaacagtacaagcgcagcaatgcgcaggagatttggccggtagtgaagccggtgtacgaaaagatggcggagatcgttgctcgccacattgaagggcaaggaattgctgatttatggctggcgggcggttcctgtatgcagccgggcgtggaggcgttatttcgccagcgtttcccggagttacaggtgcatttaccgcagcacagcctgtttatgaccccgctggcgatagctaacagcgggagagcgaaagcggagggactctatgcaagctgaactacagacggcgctgtttcaggcattcaacaccctgaatctgcaacgggtgaaaacgttcagcgtaccgccggtcacgctgtgcgggcttggggcgctcggcgcctgcgggcaggaagcgcaagcgcggggcgtaagccatttgtttgtgatggtcgacagcttcctgcatcaggcgggaatgaccgcgccgctggcacgcagcctggcgatgaaaggcgtggcgatgacggtctggccgtgtccgccaggcgagccgtgcatcaccgatgtctgcgcggcggtggcgcaactgcgtgaggcggcgtgcgacggcgtagtggcctttggcggcggttcggtgttggacgcggcgaaagcggtcgccctgctggtgactaaccctgaccagacgctgagcgccatgaccgagcgcagtacattacgcccgcgtctgccgctgattgcggtgccgaccaccgccggaaccggttcagaaaccaccaacgtgacggtgattatcgacgcggtcagcgggcgcaagcaggtgctggcacacgcgtcactaatgccggatgtggcgattcttgatgctgccgtgaccgaaggcgttccgccaaatgtgacggcgatgaccggtatcgatgcgctgacgcatgcgattgaggcctacagcgcgctcaacgccacgccgtttaccgacagcctggcgattggcgcgatagcgatgattggcaaatcgctgccgaaggccgtcggctatgggcaggatctggcggcgcgtgaaaatatgttgctggcctcctgtatggcgggaatggccttttccagcgccggtctggggctgtgtcatgcgatggcgcaccagccaggggcggcgctgcatattccgcacggccaggccaacgccatgctgctgccgacagtcatgggctttaaccggatggtatgccgcgagcgcttcagtcaaatcggtcgggcgttaaccaataagaaatcggacgatcgcgatgcgattgcggcggtgtgcgagctgattgccgaagtggggcagagcaaacggctggctgacgctggcgccaaacccgaacactacagcgcgtgggcgcaagccgcgctggaggatatttgtctgcgcagtaacccacgcaccgccacacaggcacagattatcgacctgtacgcggctgccgggtaatgctgtaggccggataaggtgctcgcatcgccatccggcaataacacggcgttaatgccggaggcgacgtaaacgtcttatccggcttacaaatcaaaaatgacagggagtaggggctatgggaattaacgaaatcatcatgtacatcatgatgttctttatgctgattgccgccgtggacaggatcctgtcgcagttcggcgggtcggcgcgcttcctcggtaaatttggcaagagtatcgaggagtctggcggccagtttgaagagggctttatggcgatgggcgcgttgggactggcgatggttggtatgaccgcgctggcgccggtgctggcgcatgtactggggccggttattatcccggtatacgaaatgctgggcgcgaacccatccatgttcgcgggtacgctactggcttgtgatatgggcggattcttcctcgccaaagagctggccggcggtgatgtcgcggcgtggctatactcagggttaatacttgggtcgatgatggggccgaccattgtgttctccattccggtggcgctcggcattatcgaaccgtctgaccgccgctacctggcgcttggcgtactggcgggtatcgtcaccattcccattggctgcattgcgggggggttgatcgccatgtactcaggtgtgcagatcaatggtcagccagtggagtttaccttcgcgctgatcctgatgaacatgatcccggtattgatcgtcgcggtgctggtagcgctggggctgaagttcatcccggaaaaaatgatcaacggtttccagattttcgccaaatttctggtggcgctgatcaccatcggtctggcggctgcggtggttaaattcctgttgggctgggagttgattccggggctcgacccgatctttatggcgccaggcgacaaacccggcgaagtgatgcgcgccattgaagtgatcggctctatctcctgcgtgctgctcggcgcgtatccgatggtgctgttactgacccgctggtttgaaaaaccgttgatgaatgtcggtaagctgctgaacgtaaataatattgcggcggcaggcatggtagcgaccctggcgaacaatatccccatgttcggcatgatgaagcagatggatacccgcggcaaagtgattaactgcgcatttgccgtctctgcggcgttcgcgctggtcgaccatttaggcttcgccgctgccaacatgaacgccatgatcttcccgatgattgtcggcaagctgatcggcggcgtgacggcgattggcgtggcgatgatgctggtgccgaaagatgacgccgcccaggtgaaaaccgaagcggaggcgcaatcgtgaacactcgccagctactgagcgtcggtatcgatatcggcaccaccaccacgcaggtgatcttctcgcgcctggagttggttaaccgtgcggcggtgtcgcaggtgccgcgctacgaattcatcaaacgcgacattagctggcaaagcccggtcttctttacgcccgtggataagcagggcggtctgaaagaggcagaacttaaagcgctgattctggctcagtatcaggccgcaggcatcgcgcctgaatcggtggactcaggggctatcattatcaccggcgaaagcgccaaaacccgcaacgcccgtccggcggtcatggcgctctcgcagtcgctgggcgactttgtggtcgccagcgccgggccgcatctggaatcggtcattgccggttacggcgccggggcgcaaagcctgtctgagcagcggatgtgccgggtgctgaatattgatatcggcggcggcacgtctaactacgcgctgtttgacgcgggaaaagtcagcggcaccgcctgccttaacgtcggtggtcgcctgctggaaaccgacgctcaggggcgcgtggtttatgcccatcagccggggcagatgattatcgatgaggtgttcggttcgggtactgatgctcgcgccttagctgccgcacagttggggcaggtggcgcggcggatggcggatctcatcgtcgaggttatcactggcgcgctctcgccgctggcgcaatcgctgatgcaaaccgggctgctgcccgccgatattacgccggaggtgatcaccctttccggtggagtaggtgaatgctaccgcaaccaacctgccgatccgttctgcttttctgatatcgggccgctgctggcgaccgcgctgcatgagcacccgcgtctgcgcgagatgaacgtgcagtttccggcgcaaaccgtacgcgccacggtgattggcgcgggggcccatacgctctcgctttccggcagtactatctggctggaagacgtccaactgccgctgcgcaacctgccggtggcgatcccgcaggatgacgccgatttggtgaacgcctggcggcaggcgcttctccagcttgatctcgacccgcaaaccgacgcttacgtgctggcgcttccctccacgcttccggtgcgttacgccgcattactcacggtcatcaacgcgctgacggcttttgtcgcgcgttatcccaatccacatcccctgctggtggtggccgagcaggattttggtaaagcgctgggcatgttattgcgcccacagttaccgcaacttccgctggcggtcatcgatgaggtggtcgtgcgggcgggagactatatcgacattggtacgcctctttttggcggatcggttgtgccggtgacggtgaaatcactcgcatttccttcctgagggaacgacttatgaaactaaagaccacattgttcggcaatgtttatcagtttaaggatgtaaaagaggtactggctaaagccaacgaactgcgttcgggggatgtgctggccggggttgccgcggcaagttcgcaggagcgcgtagcggcaaaacaggtactgtcggaaatgacggtggcggatatccgcaacaatccggtgattgcctatgaagaggactgcgtgacgcgcctgattcaggatgacgtcaacgaaacggcctataatcggattaaaaactggagcatcagcgaactgcgcgaatacgtactgagcgatgaaacctccgtggacgacatcgcgtttacccgcaaaggcctgacctccgaagtggtggcggcagtggcgaaaatctgctccaacgccgacctgatctacggcggtaagaaaatgccggtgatcaaaaaagccaataccaccatcgatattccgggcacctttagctgccgtttgcagccgaacgatacccgtgacgatgtgcagagtatcgccgcgcaaatctacgaagggctttctttcggcgcaggcgatgcggtgatcggcgttaacccggtgaccgatgacgtggagaacctgacccgcgtgctcgacaccgtttacggcgttatcgataaattcaatattccgacccagggctgcgtgctggcgcacgtcaccacccagattgaagcgattcgtcgcggcgcgccaggcggactgattttccagagcatttgcggcagcgagaagggcttaaaagagttcggtgtcgagctggcaatgctcgacgaagcgcgggcagtgggggcggagttcaaccgcatcgccggggaaaactgcctgtactttgaaaccggacagggctcggcgctgtcggctggtgcgaactttggtgccgaccaggtgacgatggaagcgcgtaactacgggctggctcgctactacgatccgttcctggtgaacaccgtggtgggctttatcgggccggagtatctctacaacgacaggcagattatccgcgccggtctcgaagatcactttatgggcaagctgagcggcatctcgatgggctgcgactgctgctataccaaccatgccgacgccgaccagaaccttaacgaaaacctgatgattctgctcgccactgccggctgtaactacatcatggggatgccgctcggcgacgacatcatgctcaactaccagactaccgctttccacgataccgccaccgtccgtcagttgctgaatttacggccgtcgccggagtttgaacgctggctggaaacgatgggcattatggcaaacggtcgtctgaccaaacgggcgggcgatccgtcactgttcttctgatgacgcggggataacaccatggatcaaaaacagattgaagaaattgtacgtagcgtgatggcgtcaatgggacaggacgtaccgcagcccgtcgcgccgtcaacgcaggaaggcgcaaagccgcagtgcgccgcgccgacggtgaccgaaagctgcgcgctggatttaggttccgcagaggcaaaagcctggattggcgtcgagaatccgcatcgtgcggacgtgctgaccgaactgcgtcgcagtactgcggcacgcgtctgtacgggtcgtgccgggccgcgtccgcgcacccaggcgctgttgcgcttcctggcggatcactcccgttcgaaagacaccgtgctcaaagaagtgccggaagagtggggcaaagcgcaagggctgctggaagtacgttcggagatcagcgacaaaaacctgtacctgacgcgcccggatatggggcgtcgcctgagcccggaagccattgacgcgctgaagtcgcagtgcgtgatgaacccggatgtgcaggtagtggtctccgatggcctctctacggatgcgatcaccgccaactatgaagagatcctgccgccgctgcttgccggtctgaagcaggccgggctgaacgtcggcacgccgttctttgtgcgctatggccgcgtgaagattgaagatcagattggcgaaattctcggcgcgaaggtcgtcatcctgctggtgggcgaacgtccggggctggggcagtcggaaagcctctcctgctacgccgtctattccccgcgcgtggcgaccaccgtcgaggccgacagaacctgtatttcaaacattcatcagggggggacgccgccagtagaagctgccgccgtgattgtggatttggccaaacggatgctggagcagaaagcgtccggcatcaacatgacccgttaaggagacatcatgcctgcattagatttgattcgaccttcagtgactgccatgcgcgtgattgcctccgtgaatgacggctttgcgcgggaacttaaattaccgccacatatacgtagtctcggactcatcacggcagattctgatgatgtgacctatattgccgctgacgaagcgaccaaacaggcgatggtggaagtagtctatggccgctccctctatgccggggcggctcacgggccgtcgcctaccgccggtgaagtgttgattatgctgggcggaccgaacccggcggaagtgcgcgccggtctggatgcgatggtcgccagtattgaaaacggcgcggcgttccagtgggcgaacgatgcggaaaataccgcgttcctggcgcatgtggtttcgcgtaccggctcgtacctctcgtctaccgcaggtatcgcgctgggcgatccaatggcctacctggtggcgccgccgctggaagcgacattcggcattgacgcggcgatgaaatccgctgacgttcaactggtgacttacgtgccgccgccgtcggaaaccaactattcggccgcgtttttaacgggaagccaggccgcgtgtaaagccgcctgcaacgcctttaccgacgccgtgctggatatcgcccgtaaccctgtccagcgtgcgtaacggaggctgccaatgatcaatgccctgggattactggaagtggacggaatggtcgccgccgtcgatgcggcggatgccatgctgaaagcggccaacgtgcgtttgctcagtcaccaagtgctcgaccctggcaggctcacgctggtggtggagggcgatctggcggcgtgtcgtgcggcgctagatgccggaagcgccgccgcgcagcacacaggccgtgtgattagtcgcaaagaaattggtcgtccggaagaggacacccagtggctgattggcgggtttgcgcgtgcgacaacgccgactgagaaagcgccccaggtacccgcaacgcctgagttcgctgaagcgttactggcgctgctggcatcagtacgccagggaatgacggcgggagaggtggccgcgcattttggctggccgctggagcaggccagaaacgtgctggaacaactcttttctgacggagcgttgcgtaaacgcagtagtcgctatcgcatcaaaaattaatctgtcggagggccgggcgtcctggcgggcgtccggcatagaagatcatgaaaaaaacccgtacagcgaatttgcaccatctttatcatgaagcgttacccgaagacgttaaacttacgcccagagtcgaggtggacaatgttcatcagcgacggacgacggatgtctatgaacatgctctgactatcaccgcctggcagcagatctacgatcagttacacctgggtaaatttcatggcgagttcacggaaatcctgcttgatgagattcaggtgttccgtgaatacaccggcctggcgctgcgtcagtcgtgtctggtttggccaaactctttctggtttggtattccggcgacgcgcggcgaacagggatttattggcgcgcaggggctcggcagcgccgagattgccacccgaccgggaggcaccgagtttgaactgagcacgccggatgattacaccattctgggcgtcgttatctcggaagatgttatttcccgtcaggccacgtttttgcataacccggaaagggtgctgcatatgctgcgtaaccagttagcgctggaggtaaaagagcagcataaagcggcgctgtggggctttgtgcagcaggcgctggccacctttagcgagagtcctgaaaccctgcatcaacctgcggtgcgtaaggtcttgagtgataatttgttgctggcgatgggcacgatgctggaagaggcgaagccgattcatagcgccgaaagcatcagccatcagggatatcgtaggctactgtcgcgggcgcgggaatatgtgctggaaaatatgtcggagccgctgacggtgctcgacttatgtaaccagctacacgtaagccgtcgcacgctgcaaaatgcgtttcacgccattttgggcattggccccaatgcgtggctgaaacgtattcgcctcaatgcagtgcgccgggagttgattagcccgtggtcgcagagcaccacggtcagagatgccgcgatgcagtggggattctggcatctggggcagtttgccaccgattatcagcaattatttgccgaaaaaccgtcgttgacgctgcatcaacggatgcggcaatgggcttgatattgatgggtaggctctccggttgctgataacgtgcgcgtgtcgggaattgcccggtggcggctggcgccttaccgggcctacggattcgctgctgtttgtggttggtagcccggacaaggcgcgccagcgccgcctccggggaagcgcgcgcacaacgtgcaaaacagttttgtcatcagatcatgaggatgagcgtttatgtttgctgataagacgttgccgttgtttggcaggaggggcagataaacccgtaaagcattccttccgcatattcctcttcctcgatatcttcatagcttagctgcgcaagaaacatcatcgtttgcgcgcacgttgggcacgtgggatagtctgtatcctgaacccatgcgggatggccgccgagctgtgagaaggtggtgggtaaaaatatttcagcagcgaatagcggcaaacgggattccccggggtgcagaacatcaagcggtagcgttatccagtcagaggaattctccaccgccagcgtcgagagcgcatttttttcgtaccatcgcggctggccttgtggatcgacggtggcgaaaacggtgttatatgccgtacaacactgacaggtcagaatacgaatttgaccgggccaaccctgcgtgcttaggccgacggcgctcggcgcaacctcaaacagattgattagcggcagggaacagtgtgggcagttttcaccatattctgcaacggcgcgaaaaacggccggctgttcaggtgcctgttttaccagatgggtacattgcgtaaagtaaagatcgcgcctgcggccattttcagtgagctcccatcccgcctggtgagcatagcgatgagggaggatatgaagtgaagcactccacgcaggtggttcctggcgccagcggttaaaatgctcaacgacaacctcatcgccaatccaggccagggcgcaaagaatgccatcacggttttcgtcatcggtttcaaccttctgcaaaagcgcgtcgcgtacgtcaggcggcgcacggtgaaaaggtaggggtgaagagagctccagttcctcttcatttattacttggcgcaggaaattatccagattggcctgggtaaatgccgccaggcacagcgcaatttcctgagcttcctcctgccatccggaatcaaataattcttctgcataatcgaccatgtcgcggctttcatcatcggagagctttttgtaaagctcatcggtcggaatggggcagggaatccactcgattaacggatcgtgttcccggggttcatgaacgagtttaagcatttcaacagggttggtaatgccactgaacgcgtcgatcgtttttctgtttttccggatatattcttcctgctcttgccgatagcgcgcctggacgcagggcatgcaatagccctccgtgcgggcagccgttgctggcaggatgaaatgtgagcattgcgggtttttacaaggaatacgctcgtccatgcggtagtgctccactgcaaattctacgagtgtttactgtactgttttactaatgataacggcagcgggcggttatccgaattctttatctacaatgaactcgtttatttctacgagcctgcttttattcaacggccaaccggataggcgataaacaaaccggctatcgtcaaaatacatgccagtaggcatagcaagatgcagttaacgcttttacgcggaatatgaataataaagcagagtaatgctatcagggccatgaccacagggatggtcaccatattgataaccagaagcacgatcagaccgaagctcacccctccgctatgagggatgaatattctttcttcaaaatatatttctagcgtaatggcaagcaggcagccaataaaacttatacccagatggggatgccatttggcgtcactggttactactttccgtgtatttgtttgcattgttttactttataaataagttaaatccagtcgcgtacctgaataaactcgctcagcgccgcttccgggctacccgcttccggctgccagtcgtactcccagcgcaccagcggcggcatcgacatcaggatagattcagtgcgcccgccggtttgcagaccaaacagggtgcctctgtcccataccagattgaactccacgtagcgaccgcggcgataaagttgaaaattacgctcccgctctccccagaccatcgctttgcgtcgttcgacaatcggtaaatacgcctcggtgtagccgttaccgaccgcctgcataaaagcaaaacagtggtcgaaatccggcgtattcaaatcgtcaaaaaacaggccgccgataccgcgctgctcgttacgatgcttgaggaaaaagtagtcatcgcaccactttttatagcgcggatacacatcgtcgccaaacggctggcacaggtcgcgggcggtgcggtgccagtgaacggcatcctcttcaaagccgtagtagggcgttaaatcgaacccgccgccaaaccaccacaccggatcggcgcccggtttttcggcaataaaaaagcgcacgttagcatggctggtgggaatatacggattgtgcggatgcaccaccagcgatacgcccatcgcttcaaaactacgcccggccagttctggccgatgtgcggtggcggacgcgggcattgcatcgccgtgaacgtgagagaaattaacgcccgcctgttcgaaaattccgccgttgcgtaatacccggctgcgtccgccgccgcccgcttcgcgtcgccagctatcttcgataaagtttgcgccatccacagcggataacgtttggcaaatatcatcctgcaggcgtagcagaaactgttttacgtgatgtgcatcgggtttcatgattaccgtttcttcgtgtgtgctttctgattatcaaaccagtgaaaataactgatgatgccgttggcgatcgccgtagcgattttctggcgaaacgccgtcgtgcccagcaggcgttcttcttccggattggtaataaacgaggtttcgaccagtaccgacggaattgacggtgattttagcaccacgaaagccgcttgttcggtagtgcggctgtgtaatttatgtatgggtttgattttcttgagaatatgcgaacccagcgtcagactgtttttaatcgtatcggtttgcaccagatcaaacaaaacttgttgtaatagatgatcccggtcagtggcttttttacccgccacttcgtccgcgcggttttcacgctcggagagatacttcgccatggcgctactggccccgcggttggaaagcgcaaaaacggaagcgcccgccgctttcggattggtaaaaccatcggcatgaatagacataaacagatccgcgccgtgcttatgggcgatttccactcgatcgtacagcggaataaaggtatcccctgtccgggttaaacgcgcatcgattccgtgatttcgcaaaatagcgcgtacgtttttggcaattgccagtacgacgtgtttttcctgagaaccgttgcggccaatcgcgccggtatcgatgccgccgtgtccggggtcgagcatcaccaaccgtttactgccggtttttttggttttgggtttgctgtgaccattactggtttttagcgtttcttctttggctattgcgtgcgacatacctgacagcgtcagggccgccagacctgttttgagtacctggcggcgcgatgtgagagtttttaggagtttaaaagtgctcatacggcctgagttgtgaaaattaagttcaagatgttatatcgtatcgcgtaatccgttacgacggttggtgatgagaattgttttacttttcatttcaatacgtgacacatcgccattatgccattttttccgctacatcgcgtcagatattggctgaatcagatgtttgcgccataatcttggtttttccacccgaaaaggcaacgaataccatggaaatacgcgtttttcgccaggaagatttcgaagaggtgattaccctctgggagcgttgcgacctgctgcgtccatggaacgatcctgaaatggatattgaacgcaaggtgaatcacgatgtcagcttgttcctcgttgcggaagttagcggcgaagtcgtcggtacggtaatgggcggttatgacgggcatcgcggctcggcgtattacctgggcgttcacccggagttccgcgggcgcggcattgcgaatgcgctgcttaaccggctggaaaaaaaactcatcgcccgcgggtgtccgaaaatccaaattatggtgcgtgatgataacgacgttgtgctgggcatgtatgaacgtctggggtatgagcattctgacgccctaagtttgggtaaacgcctgattgaagatgaagagtactgagtttcatccagccgattatgatgtacacggatgtttacgcctgccgtttctgttctggtgcgtactgctacttcaggcgcgcgcctgggtactctttgtcattgccggttcatcccgtggacagggtaatactttgttaaactttttttatcccgaccatgataatttttggctggggctgttgcccggcgttccggcggtagtggcgtttttactcagcgggcggcgtgaagcggttcctggtgtgtggcgctggctgcgcggactcctgatcctcgctcaactggtgtcgttgtgctggctgccggtgatgtggctgggtggcgacccggtcaacggcgtcgggctggcgctgctgctggcggacatcgtcgcgctgatctggctgttaaccaatcaacgtttgcgtgcctgtttttcccttgagaaagaataacggcactttttggcgaacccgtactccaaccaacgttaattaataaaagaaaggaagtgagatgaaatcgctgcgtttgactttactcgcactgccgctggcgctgaccggctgctcgacgctctcctcggtcaactggtctgccgcaaatccatggaactggtttggttcctcgacagaagtcactgagcaaggcgtgggagcgctgaccgccgccacgccgctggaagagccggctattgcagaggcattagatggcgattatcgcctgcgtagcggtatgaaaaccgataacggcaacgtggtgcgctttttcgaagcgatgaagggcgacagcgtcgcgatggtgatcaacggcgagcagggaaccgtgagccgtattgatgtgctggacagcgatatcccaaccgccgcggggggcaaaatcggtacgccgtttagcgacctttacagcaaagcgtttggtcactgcgagccggtttccagcgatagccataccagcgtcgaatgtaaagccgagggaagtcagcatattagctatgttttctccggcgagtggagcggaccggaaggcttaatgcctcctgatgacgtcttaaaaaactgggacgtgcgcaaaattatctggcgtcgttaatttgcgcctgaacaaaccgcttcgcttaaaaacaaggtaaaataacctccattaatgccacgactgcgtggcattctcattttcaggaggaatcatgtctcaggttcaaagtggcattttgccggaacattgccgtgcggcaatttggattgaagccaatgtaaaaggcgacctggacgccctgcgcgcggccagcagaacatttgccgataaactggcgaccttcgaagtcaaatttccggacgcccatcttggggccgttgtggcgtttggcaacaatacctggcgtgccctgagtggcggcgtcggggcggaagaactgaaagattttattccttatggtaaagggctggcgccagccacgcagtatgacatgctgatccatatcctttccctgcgccacgatgtgaatttttctgttgctcaggcggcgatggaagccttcggcgactgtatcgacgtgaaagaagaagttcacggcttccgttgggtggaagaacgcgatctgagcggctttgtcgacgggacagagaacccggcgggcgaagagacgcgtcgtgaagtggcggtgatcaaagatggcgtggatgccggcggcagttatgtgttcgtgcagcgttgggaacacaatctcaagcaacttaaccggatgagtattcacgatcaggagatgatgatcgggcgtaccaaagaagccaatgaagagattgacggcgatgcgcgtccggcaacatctcacctgagccgcgtcgatctcaaagaagatggcaaagggctgaagattgtgcgtcagagcctgccatacggcaccgccagcggtactcatggtctctatttctgcgcttactgcgcacgcctgcacaatatcgaacagcagcttctgagtatgttcggcgataccgacggtaaacgcgacgcaatgctgcgcttcaccaaaccggtgactggcggctactattttgcgccgtcgctggatcgcctgttagcgctataagtaaaaccctgtcggatggcagcgcaaacgctttattcgacctacgattggtaggcctgacaagcgccgcgccatcaggcagaacagcataaaaatgcccatccccgcctccgcggggatttttttacctaatatttacctgaattagtgagctattcctcagcacttatttgttattactgtattttcagtgttaatggagtgtaagactccatattcaaaaggagacattgaaaatgggtaaactcacgggcaagacagcattgattacgggcgcatcgcagggcattggcgaagggatcgctcgcgtattcgcacgccacggcgcgaacttaatcttgctggatatctccgatgagattgaaaagctggcggatgagctgggcgggcgcgggcatcgctgtactgccgttaaagccgacgtcagagattttgcttcggtgcaggcggcggttgcgcgcgccaaagagactgaaggtagaattgatattttggtgaataacgctggcgtgtgccgtctgggcaacttcctcgatatgagtgaagaagatcgcgatttccacattgatattaatattaaaggtgtctggaacgtcaccaaagccgtcctgccggagatgatcaaacgtaaagatggccgcattgtgatgatgtcttccgtcacgggagatatggtggcggacccgggtgaaacggcctatgcgctgtcaaaagccgccattgtcggtttaaccaaatcgctggcggtagagtacgcgcagtccggtattcgtgtgaatgccatttgccccggttatgtaagaacgccgatggcggaaagcattgcccgtcagtctaaccctgacgatccggaatcggtattaacggaaatggcaaaagccattccgctacgccgtcttgccgatccgctggaagtaggggaactggcggcatttctggcttccgatgagtccagctatcttaccggaacgcaaaacgtcattgatggcggcagtaccctgcctgaaagcgtaagcgtaggcgtctgattgatgccggtctcctcctcacgccgcgtggggagggattctcttattcccttttcaactttcaaatcatcaaacggtatataaaaccgttactcctttagcgctggttataaatatgatgaccataagaaagtcattaaatttataagggtgcgcaatggccgttaacttactgaaaaagagactcctgacgctggcagcaatgctgttactggcagggcaggcgcaggcaacggagctgctgaacagctcatacgatgtctcccgcgagctgtttgccgcccttaacccgccgtttgagcaacaatgggcgaaggataacggcggcgataagctgacgattaagcagtctcatgccgggtcatcaaaacaggcgctggcgattttgcagggactgaaggcagacgtcgtgacctacaatcaggtgaccgacgtacagattcttcatgataaaggcaaactgatccctgccgactggcaaagccgtctgccgaacaacagttcgccattctattccactatgggcttcctagtgcgcaaggggaacccgaaaaatattcacgactggagcgatcttgtacgtttcgacgtgaagctgattttccctaacccgaaaacctccggcaacgcccgttacacgtatctggcggcatggggcgcggcggataacgcggacggcggcgataaagccaaaaccgaacagtttatgacccagttcctgaaaaacgtcgaagtgtttgataccggcggtcgcggcgctacgactacctttgccgagcgtggtctgggcgatgtgctgattagttttgaatcggaagtgaacaacatccgcaaacaatatgaagcccagggatttgaagtggtgatcccgaaaacgaacattcttgctgaattcccggttgcctgggtggataaatacgtgaaggccaacggcacagaaaaagccgccaaagcttacctgaactggctgtatagcccgcaggcgcagaccatcattacccattactactaccgcgtgaataacccggaaatcatgggcaagcaagcagataaattcccgcaaaccggactgttccgcgtggaagacaagtttggcacgtggcctgaggtgatgaaaacgcactttgccagcggcggcgagctggacaaactgttggcggcggggcgtaagtaatgcttgccgtttcttcccgacgcgtgctgcccggctttacgttaagcctcggcaccagtttgctgtttgtctgcctgatcctgctgttgccgttgagtgcgctggtgatgcagctctcacagatgagctggtcgcaatactgggatgtcgtgaccaacccacaggtggtggctgcttataaagtgacgctgctggcggcatttgtggcgtcgatttttaatggcgtgtttggcctgctgatggcgtggattttaacccgctaccgttttccagggcgcacgttactggatgcgctgatggatctgccatttgcgctgccgacagcggtggcggggttaacgctggcctcgctgttctcagtgaacggtttctacggtcagtttcttgcgcagtttgatatcaaagtgacctatacctggctcggtattgcggtggcgatggcctttaccagcattccatttgtggtgcgcaccgtccagccggtactggaagagctggggccggaatatgaagaagcggcacaaacgctgggggccacccgcctgcaaagttttcgcaaagtcgtgctgcctgagctgtcgcctgcgctgattgccggcgtggcgctctcttttacccgtagcctgggcgagtttggcgcggtgatttttatcgccggaaatatcgcctggaaaacagaagtgacctcgctgatgatttttgtgcgtttgcaggagtttgattacccagctgccagcgccattgcctcggtgatccttgcggcatcactgctgctgctgttctcaattaacactctgcaaagtcgctttggtcgacgtgtggtaggtcattaatggcggaagtgactcaattgaagcgatacgacgtcccccgtattaactggggaaaatggtttttgattggcgtcgggatgctcgtttcggcctttatcctgctggtgccgatgatttacatcttcgtgcaggcgttcagcaaagggttaatgccggtactgcaaaatctggccgatccggacatgctgcacgccatctggctgacggtgttgattgccttgatcgcagtgccgatgaatctggtgttcggtattctgctggcgtggctggtgacgcgctttaacttccccggacgtcagctactgctgaccctgctggatattccctttgccgtctcaccggtggtggccggtctggtttatctgttgttttatggttccaacggcccgttgggcggctggctggatgagcataatttgcaaatgatgttctcctggccggggatggtactggtcactatttttgtcacctgcccgtttgtggtgcgcgaactggtgccagtgatgctcagccagggcagccaggaagatgaggcggcgattttactgggcgcatccggctggcaaatgtttcgccgcgtgacgttgccgaatattcgctgggcgctactctacggcgtggtattaaccaacgcccgcgcgattggcgagtttggcgcggtgtcggtggtgtccggctcgattcgcggcgaaacgttatcgctaccgttacagattgaattactggagcaggactacaacaccgtcggctcctttaccgccgccgcattgttgacgctaatggcgattattaccctgtttttgaagagcatgttgcaatggcgtctggagaatcaggaaaaacgcgcgcaacaggaggaaaatcatgagcattgagatcgccagaattaagaaatcgtttggtcgcactcaggtactgaatgatatctcgctggatattccttccggccagatggttgccttgttggggccgtctggttccggcaaaacgacgctgctgcgcattattgccgggctggaacatcagtccagcggccatattcgtttccacggtacggacgttagccgcctgcacgcgcgtgagcgtaaagtcggttttgtgtttcagcactatgcgctgtttcgccatatgacggtgtttgacaacatcgcttttggcctgacggtgctgccgcgacgcgaccgcccaactgcggcggctattaaaacgaaagtgacgcaattgctggagatggtgcaactggcgcacctcgcggatcgcttccccgcccagctttccggcggacaaaaacagcgcgtggcgctggcgcgcgcgcttgccgtagaaccgcaaattctactgctggatgaaccgtttggcgcgctggatgcccaggtacgtaaagagttacgtcgctggttgcgccagctacatgaagaactgaaattcaccagcgtctttgtcacccacgatcaggaagaagcgacggaagtggcggatcgggtggtggtaatgagtcagggcaatatcgaacaggctgacgcgccggatcgggtgtggcgtgaaccggcaacccgcttcgtactggagtttatgggcgaggtgaaccgcctgacaggcaccgtccgcggcgggcagtttcacgttggcgcgcatcgctggccgctgggttatacgcccgcgtaccaagggccggtcgatctgttcctgcgtccgtgggaggtggatatcagccgccgcaccagcctggattctccgctaccagtacaggtcattgaggcaagcccgaaaggtcactatacacagttagtggtacagccgctggggtggtatcacgatccgctgacggtggtgatggcgggtgacgacgtcccgcagcgcggcgagcgtttgtttgtcggcttacagaacgcacgtctctatcatggcgaccagcgtattgagccccatgaggcgcttgctcttgcggagtctgcctgataggttaatttgcatagttatcgcccggtggcgcttcgcttaccgggcctacagcgtatatcgtgattttgtaggccgggtaagcacagcgccacccggcatttttattgagctgaaaacgtgaatacattagaacaaaccatcggcaatacgccgctggtcaaattacaacggctggggccggataacggcagtgaaatctgggtcaagctggaaggcaataatccggcaggatcggtgaaagatcgcgcggcgctatcgatgattgtcgaggcggaaaagcgcggggaaattaaaccgggcgatgccctgattgaagcgaccagcggcaacactggcattgcgctggcgatgatcgccgcgctgaaaggttatcgcatgaagctgttgatgccggacaacatgagccaggagcgtcgggcggcaatgcgggcctatggcgcggaactgattctggtcactaaagagcagggaatggaaggggcgcgcgatttagcgctcgctatgtctgagcgcggagaaggtaaactgctcgatcagtttaataatcctgataatccctacgcccactacacgaccaccggcccggaaatctggcggcaaacgtcaggtcgcatcacccattttgtctccagcatgggcacgaccggcaccattaccggcgtgtcgcgttttctgcgcgagcaggaaaaaacggtcaccatcgttggcctgcaaccggaagagggcagcagtattccgggcattcgccgctggcctacggaatatatgccgggcatatttaacgcctcgctggtggatgaggtgctggatattcatcagaatgatgccgaaaacaccatgcgtgaactggcggttcgtgaagggattttctgcggcgtcagctccggcggcgcggtagcgggcgcgttacgcgtcgcacgagccacgcccggcgcgatagtggtggcgatcatctgcgatcgcggcgaccgttacttgtctaccggcgtgtttggtgaagagcatttcagccagggggcagggatttaaacgaggtgccatcgtcgtatgacacccgtgtgttatagcgttttatccgtttccgcaataagtgcatgtaaataaggctgcgcgttttcatcgcttttaccaggaattttaacgatatagggttttccggtgatggacgacgacgacgcgactttatcgataaactgttcagcggtgtcgatacgattgcgcgtgttacccagttttaagcgcaggtgcgatacggcttcctcgcagttatgcgcatcaccgttacgaacgaaggtcagatcctttttctgcgccagcacattaagcatggcgttaatgcgcgcttcttcatgggcgtttagcttcgcccaggcggggagggtcagcaggagcgcgacgacggcgcagacaattttcttcatggtaaaatcctttttcatgcaataatcactgcacctcagaccgttagccgggtaataagttgcactcctggtgtggttatttctgtgagtgcgccagcgtgagttcatccagaaaacgccacagcttttcattcatctgctgataattccatgcgcgcatctcggcgaccgagcggataaaacgcttcccttgcgcgtcggccagctcctgctgcgaatgttggattaatccttcaaccgcctcgacggtaaattccatatgacactggaagccgtagacaaaattgccgtactgcacgatttgtcgcgggcagccctcactggtagcaagaattatcgcctggtcggttaaccccggcatgtcgttatgccagtgaccgacgataagcggggagccgaaatggttgaacagcgggtgctgttggcctgcctcggtcaggacgattgggtagtgaccgatctctttttccggactttggcacaccttggcgcccagcgcttcgccaattaactgcgagcccaaacagatccccaccacgatttttcgtgccgaaatcgcctggttaatcagatgttgctcggcctgagaatcaaagtacgggcactcttcgcgggtggtgcgcggcgactgcggaccgccaaataccacgagcatatcgaactcatctgcattgggcggtagcgcttctccggcatagacgcgcgaccatgaaatggtataaccgcgatcttcagcccatttcagataagcgccagcggattcaaacgactcatggataacaaaatgaactcgcacgttattttctcctgttagcgatttagcgcctgatggatatcagccgccagcgtgttgatctcgccgtcatttaatgtcgacagcgtgatacgtagaccgtgagacggcgcgcttacgccaaaggcttcgccctcacgtaccagccagccggattttgccagcgtaaacgcggtagcctggctatgggtgtccagcgggagccaggcattcacgccgtcgccgggagaaatggcgatgccatattgctgtagggcgcgggccagtttttgttgccgggtggcgtaaaacagccgcgtttgcgccagcctgtgctgatactcagggtcggtcaggcaggcgtagaccagatcctgtaacagatggctgacccactgactaccggcatttagccgcagccgaagttttgccgaggtcgagctgtcgctggcgacaatagcaagacgtaaatcggggccgagggctttggaaacggagcgtatcaccgcccagtgttgcgttgtctgcgcaataaccggctgccagggcgacgaagaaagcagggcgaagtgatcgtcgataatgaccagtacctgagggtaacgcgccagtatattttgcagcgcagcggcacggcgagcgctcaggctacagccggtagggttgtgtgcgcgcggcgttaagatcactgcccgcgcgccctggtttagcgcctgctccagcttttcaggctgcattccttcgctatccacactgaccgggctggcgctaaaaccggcatagcgcagcatattgatactgcttaaaaaacagggatcttccaccgcaacgctgtcgcccggcagcagatgcgcgcaaagcagtctttcgatagcgtcgatagctccgctggtgatatcaatttcgcctgcgacgggggtggcatcccgtagccagcgcgccgcccaggcgtgtagttcaggggaaacgggcgcatcgccgtagagatgcggcgtgcggctgagacgggcaaaataacggctaaggtcaggcagacgctgcggatcgggattgccgccggaaaggtcgtgcagaggcgtatgcggatcgccgccttccaacgctacgggagacggactgcctttaatcaccgtcccattgcggcctaaactttgcgccagtcccgccgttatcagccgtttatacgccgctgcgacggtattgcggttcacctttaattcgcttgccagctcccgtaccggcgggagcgaatccttcgcccgtaacgtgccggcgataatgtgttgacggatactgtcaaaaatttcgttagcggtttttccgtcgatcattattgacctatgacaaaatgaattttagcatatgacaatgataatgaggcggtagcctgctgtccagcgagaggaaaattttatgggacaagagagtgatattcagtcagtgctcttcgacgacaaccatcgggcgttacagaccgatatcgtcgccgtccagtcacaggttgtgtacggcagcgtaggcaacagtatcgctgttccggccattaaagcgcagggattacgcgtgacggcggtcccgacggtgttgttcagcaatacgccgcactataaaacgttttatggcggcattattcccgccgagtggtttgcaggctaccttacggcgttgaatgagcgcgatgcgctacgtgaattaaaagcgattaccaccggttacatgggcagcgcagaccaaattgtcttgctttcgaagtggctaatggcgatccgggcttcgcatccggaggtgtgtattcttgttgatcccgtcattggcgataccgacagtggaatgtatgtgcaggcggaaattccgcaggcttatcgcacacatttgttgccgcaggcgcaggggctaacgccgaacgtatttgagctggagatgctgagtggtaaaccgtgtcgcacgctggaagaggcggtggcggcggcgcaatcgctgctttccgatacgctgaaatgggtggttatcaccagcgcgccgggcgaatctctggagaccataacggttgccgtcgttaccgcgcaggtcgtggaggtctttgcccatccgcgggtggcgacggagttaaaagggacgggagatctcttctgcgccgagctggtcagcggtattgtgcagggaaaaaaactgacgaccgcggcaaaagatgcggcgcagcgcgtgctggaggtgatgacctggacacagcagtgtggctgtgatgagttaattctgccgccggcaggggaggcgcgatgaagagttatcggctggtggttcgccagcaggggcgtatcgtggggcattttgaaacgagcgggctggacgcgctggaagatatctgcgtggcgcgagcgatgtttggcatcactggcggctatcagtgcgagttgcaagtgtccgattccgaacgcaggatactggagagtggcccggatgggatgaagatcctgatgcgcgagaagtgctttcgcccggtgacctcgcagttgtaacccgtggattggcgctgaaatgttcgcaaccttgtaggcctgataagcgtagcgccatcaggcagtgcgccgcaccatcgccggatggcggcgcaagtacaggcaaaaaaaatggcgcccaaaggcgccattcttcactgcggcaagaattacttcttaatgcggataaccggagtttcacccacggtcacgctaccggacagtttgatcagttctttgatttcatccatgttggagataacaaccggagtcagggtagacttggctttttcttccagcaacggcagatcgaactcgatgaccggatcgccaactttcacgcgctgaccttcttcagcaatacgcttgaagccttcgcctttcagctcaacggtgtcgataccgaagtgaacgaacagctcaatgccgctatcggattcgatagagaacgcatggttggtttcaaagattttgccgatggtaccgtcaacaggggcgaccattttgttaccggttggtttgatagcgatgccatcaccaacgattttttcagcaaaaactacatccggcacgtcttcgatgttgacgatctcgccagagagcggggcaacaatctcaatagttccggtgtctttcttatcatcagaaaccagagattttagtttatcgaacaaacccatgatcttctcctaagcagtaaattgggccgcatctcgtggattagcagattgttttttcttcaatgaacttgttaaccagcgtcattaactcgtccgttgtcggttgagcaagagcctgctctgctaacaccttcgcatcttcgaagttcgtgttacggataatcttcttaatgcgcgggatagaaatggcgctcatagagaattcgtccagacccatccccagcaacagaagtgtagcacgttcgtcgcctgcaagctcaccacacatgccagtccatttaccttctgcatgagaagcatcaataacttgcttgatcaagttcagtacggacggtgacattggctggtaaaggtgtgaaatcatatcattaccacggtcaactgccagggtgtactgcgttaaatcattggtgccgatactaaagaaatcaacttctttggctaaatgacgcgcaattgtcgccgcagccggtgtttccaccatcacgccaatctcaatgctttcgtcaaatgctttaccttcgtcacgcagttcctgtttgtagatttcaatctctttgcgcagcgcgcgaacttcttcaacagagatgatcatcgggaacataatgcgcaatttaccgaaagcggaggcacgcagaatcgcgcgaacctggtcacgcaggatctctttgcgatccatggcgatacgcacggcgcgccagcccaggaacgggttctcttctttcgggaagttcatgtatggcagctctttgtcgccgccaatgtccatggtacggacgataaccgcctgcgagccgcacgcttcagcgaccgctttataggcggcaaactgctcttcttccgtcggcagcgcgtcgcgatccatgaacaggaattcagtacgatacagaccaacgccttccgcgccgttacgctcagcgccttcaacgtcacgaacggtaccgatgttggcgcaaacttcaacctgatgtccatccagcgtgattgccggcagatctttcagttttgcgagttccgctttctcggtcgcaacctgctcctggacggcgcgcagttgctcaataacatcgttggtcgggttgacgtaaacctggttgtttacggcatccagaatcagatagtcgccgtttttcacctgagcggtgacgctaccggtacctacgatcgctggcagttccagagaacgcgccatgatggaggtatgagacgtgcgtccgcccgcgtcggtgatgaagcccagcactttctgcaggttcagctgtgcggtttctgacggcgtcaggtcagcggcaaccaggataacttcttcctgaatcgcgctcagatcgataatggccagacccaggatgttgcgcagcaggcgcttaccgatatcacgtacgtcagccgcacgctctttcaggtattcgtcatccagttcttccagggcagtggcctgaccttcgataacttcatgtgcggctgcgtcagccgtcatgtgcttatctttaatcagggctatgatttcctgctccagctcctcatcttcgagcagcataatatgcccttcaaagatggcttctttttcttcaccgaacgtttcaccagcttttgtcttgatcgcttccagttgcgcagatgccttggcacgaccgctcagaaaacgttcaacttcctgatcaaccttgtcggcagaaatttttttccggtcaatgacgatttcgtcttctttcagcagcagtgctttgccgaaagcgatacccggggatgctaaaatgcctgaaatcataaccctaccttacttgtgactgatttttaaaagaacccggaaaaaaacttactcgagttccgccatcagtttgaccagatgttcaaccgctttctgctcatcttcaccttctgcggagatggtgacgacggtgccttgagtcaggcccagagtctgcagtttaaacaggcttttcgcgctggcgcttttgccgttggaagtcacagtaatctcagaagtgaagccttttgcttctttaacaaactgagcagcagggcgggtgtgcagaccgttcggagcggtaatggtaacttcttgctggaacattgtatttccccaacttataggtttagtgttgtggaactaaagtctagcctggcggctcaactttagcctgtattgttagcgccggcgtaaacgggacgcgacacaaaaggtgttctacgcaatccgttgctggcaacttatggccgctgacgtttcgctcgtcattaaacattatgccgcgaaaggaagagttgaaccaaatcataaaatcgattcagctaacgcttttcctgtaacgattaatttcgcgcatcaaaataattagtctggttaaataccagttccggcagggtgaatcaatgccaggtgaggtgaaagtttgaagcaggccacaaaaaagcacccaaaaaggtgcttttttacgcgtttttaacatgctggcatcactgttgcagttctttctcagtaaagagatcggcgaacaacgcggtgctcagataacgctcacctgatgagggtaggataaccacaatattcttattggtaaagctttcatcttcctgcagcttaagcgctgcagcaaccgcggcgccggaagaaattcccgccagaataccttcctcttccatcagacggcgcgcggtagaaatggcttcttcattggtgatgccaaccactttatcaatcagtttcagatccaggttgcccgggatgaagcctgcgccgatgccctgaattttatgtgggcccggtttgatctcttcaccagccagcgcctgggcgataaccggggagtcagtgggttctaccgcaacggtgataagatcggttttacccttcgtccctttgatataacgcgtgacgccggttaacgtaccgccagtgccgacgccggagataaacacatccacctgaccatcggtgtcttcccagatttccgggccggtggttttttcatggatttccgggttggcagggttgctgaactgctggagcaggagatatttttgcggatcgctggcgacaatttcttcggctttctgaatagcgcctttcatccctttcgccccttcggtcagcaccagattcgcgcctaatgctttgagtagcttgcggcgttcaatgctcatggtttccggcatggtcagggtgagtttgtaaccgcgcgcggcggcgacatacgccagcgcaataccggtattgccgctggtcggctccaccagttccacgccaggtttcagtacgccacgcttttcggcatcccaaatcatattggcgccgatacggcacttgacgctgaagctcgggttgcgcgactccaccttcgccagaatgcgtccattaccgatacgattcagtcgaaccagcggcgtatgaccgatagtcagcgagttatcttcataaatcttactcatggcctgtccttaactgtatgaaattgggataccttcccagcataccttccagccagatatggggaagtaaggatttcgcatatctatatgctgatggggaataatggttatcagtatggaataagagacagcataagagcctatcccattagggctattttacttgccattttggtcctgggcagtgctcgccaaaacgcattagcgttttgaacgccgcttgcggcggcccgaagggcgagcgtagcgagtcaaacctcacatactacgtgtacgctccggtttttgcgcgctgtccgtgtccaaactggctgcgccaataacgcttggtgggataggctctaagccatctcttatttatacatttttacgttatttccataacgcgtgtttagcacgccagcaatcaacccacattgccgtcgcgccacagacggcgacaggcataatgaaaaggttaagcaccggaatcatcgtaaagaggctggtgagcgcgccaaattgcatattcgccaccttctgcgtgcgcaacgcggcgcgcatcgttttaaacggcactttgtggttatcaaacgggtagtcgcaatactggatcgccagcatccaggcgctgaacaaaaaccacagcaccggcgcgatggtttggccaatgccaggaataaaatagagaaccagcagcacaatagcgcgcggcagataccacgccagcttttgccattcacgtttcataatgcgcggtacatctttcatgatgccgagtatgccggtatctggcggcgtagcgccggttaaccgcgcctcaagctgttcggctaaaaggccgttaaacggcgcggcgatccagttggcgagggtagagaaaaaatagccaaagaccaacagaacagagataaccgcaatcggccacagcagatagctcagccattgcagccagtccggcacatgactcatcaacgaaggtatccaggcgtcaagctgggtaaacagccaccaaaatgcgccgcccatcagcacaatattgaccagcaaaggtaaaataacaaagcggcggattcccggtagggtgactaacttccatccttgcgagaaataatagacgccgctacgtggtacggttgtggatgatgaaaccatattcaggacatactcctttttcttaaagccctgggtaaacgtgggatatcttacccggttatcagacggtggatagttcggaaatgttcgaaaaaacagcaaaaagcacattttccttcatctttatgctgcgaaagccaacagtacacttgcacttgacgtaatcggcaaatactcttagtgagtaaatgtttgccgtggtggcaaggtgttagaacaacagagaatataatgatgcaggatttgcgtctgatattaatcattgttggcgcgatcgccataatcgctttactggtacatggtttctggaccagccgtaaagaacgatcttctatgttccgcgatcgtccactaaaacgcatgaaatcgaaacgcgacgacgactcgtatgacgacgatgtcgaagaagacgaaggcgtgggtgaagttcgtgttcaccgcgtaaatcatgcccccggccagtcgcaggagcatgatgcccctcgtcagtcgccgcaacaccagtaccagccgccttatgcgtctgcgcaaccgcgtccagcggcgccgccgcagccgcaagcgccgatgcaacagccggttcagcaaccggtccaacctgcgccgcagcctcagcaggttcagccatctgcgccgccggtacagccgccgcaacagcagcctgcaccgccgtcgcaagcgccgcagcctgttgcgcagcccgcgccgccgccatcagcgcaaaccttccagcctgcggaacctgtggttgaggcggaaccggtagtggaagaagcgccggttgtggaaaaaccgcagcgtaaagaggcggtcatcattatgaacgtcgcggcccatcatggcagcgagcttaatggtgaagtgttactgaacagtattcagcagtcaggctttaaatttggcgatatgaatattttccatcgtcatttgagcccggacggcagcggcccggccttgttcagtctcgcgaatatggtcaatccgggaacgttcgatcctgaaatgacggacttcactacgcctggcgtcactatctttatgcaggtaccgtcttacggcgatgcgctgcagaatttcaagctgatgctgcaatccgcgcagcatatcgctgatgaggtcggtggcgtcgtgctggatgaccagcgtcggatgatgacgccgcagaaactgcgcgaatatcaggaccgcatccgcgaggtgatggacgctaacgcctgaggttaacgcaggtgtgacatttttaacgtaacccccgcctgtcgggggttttttatcattgatggtgtgatatggaaccaatcgaacaacaactgacagaactgcgaaccacgcttcgccatcatgaatatctgtatcatgtgatggatgcgcccgagattctcgacgccgaatatgaccgcctgatgcgggaactgcgagagctggaggcgcaacgtccggaccttatcacgccggattcgcccacgcagcgcgttggcgcggcgccgctgacggcattcaaccagattcgccatgaagtaccgatgctgtcgctcgataacgtatttgatgaagaaagcttcctggcgtttaacaagcgagtgcaggatcgtctaaaaagcacggaaaatgtcatctggtgctgcgagctaaaactggatggcctggcggtcagcattctgtatgaaaacggcgtgctggtgagcgctgcgacgcgtggcgacggcaccaccggtgaagatatcacttcaaacgtgcgcacgattcgcgccattccgttaaagctgcacggcgataacattccggcgcgtcttgaagttcgcggagaggtatttttaccgcaggccgggttcgaaaagatcaatgaagacgcgcgccgtactggcggcaaagtgtttgctaatccgcgtaacgcggcggcgggctcgttgcgtcagctcgatccgcgtattacggcgaagcgaccgctaacatttttctgctacggcgtcggtattctggaaggcggagagttgccggatacgcatctgggacggttgctgcaatttaaagcgtgggggttaccggtcagcgatcgcgtgacgctgtgcgattctccccaggcagtactggatttttatcacaacgtcgaaaaagatcgccccacgctcggttttgatatcgacggcgtggtgattaaggtcaactcgctggctttgcaggaacagctgggctttgtggcccgcgcgccgcgctgggcggtggcgtttaaatttcctgctcaggagcagatgacttttgtgcgcgacgttgagtttcaggtcgggcgcaccggggcgattacgccggtggcgcgtctagaaccggttcaggtggctggtgtgctggtcagcaatgccacgttgcataatgccgatgaaattgagcggcttggcttgcgcattggcgataaggtggttatccgtcgggcaggcgatgtgatccctcaggtggtcaacgtggttctgtccgaacgccctgaagagacgcgtccgattgtgtttccaacgcactgtccggtgtgcggatcggacgtagagcgcgtcgaaggcgaagccgttacccgttgtaccggcgggctgatttgcggcgcgcagcgtaaagagtcgctgaaacattttgtgtcgcgccgggcgatggatgtagacgggatgggcgataagatcatcgaccaactggtggaaagggagtatgtccatacgccagcggatctgttccgtctgacggcgggtaaactgaccggcctggaccgaatggggccaaagtccgcgcaaaatgttgttaacgcgctggaaaaagccaaagcgacgacttttgcgcgttttctctatgcgctgggcatccgtgaagtgggtgaagcgacggcggcggggctggcggcgtacttcggcacgctggaggcgctgcaggctgccaccattgacgagttgcagaaagtacccgacgtggggattgtggtcgctacgcacgtctttaacttttttgccgaagagagcaatcgtgacgtgattgggcagctactggcggaaggggttcactggcccgcgccggtagtcattaatgcgcaagagatcgatagcccgtttgccggtaaaaccgtggtactaaccggtagcctgagccagatgtcccgcgatgacgctaaagcgcgtttagtggctctgggcgcgaaagtggcaggcagcgtatcgaagaaaaccgatctggtgattgccggtgaagcggcgggctccaaactggccaaagcgcaggaactgggtattaccgtgattgatgaagcggaaatgatccgcttactgggtgcctgagatggaaaaagagcagctgcttgaaatcgccaacaccgtgatgccctttggcaaatatcagggacgtcgattgatcgaccttccggaagagtatttgctgtggtttgcccgtaaagatcaatttccggcgggtaaactaggggagttgatgcaaatcacgctgctgattaaaaccgaggggctgacgcaactggtgcagcccctgaaacgcccgctttaagctttcgcggcgcggctttcctgctgcgcctgtaacttctcggtctggcgtttgtagcgccgcgccagccctgcgcagaccatcagttggatctggtggaagatcatcagcggtaataccatcatacccagcactgacgtcggaaacagaatattggccatcgggatcccgttggccaggctttttttcgaaccgcagaagacaatagtgatttcgtcggctttattgaagccgcatttacgggcgacaaagacgttaatggctatgacgatcgccagcagtatgaggctgaccacgacgataaacagcagcgatccccagccgactttgtgccagatgccgttgaccaccgcttcgctgaacgccgagtagaccaccaacagaatagaggtctgatccgttttcgcgatccactttttgttgcgcgcgacccaattgccgatccacgggcgagacaggtgtcccagcacaaaaggcagcagcagttgcagcataattttgcccacctcttccagactgccctgcgcgccatgaatattcattaccagaccgaccagcagcggcgacaggaaaatgcccagcaggctggacgcagacgctgagcacaccgcggccgcgacgttgccgcccgcgagtgaagtaaatgcaatcgccgactgcacggtggcgggcaaaatacacagatacagaaagccgctgtagagcatagggtcgacattgacaggcgcccaccaggcaaacagcacgccgaggacaggaaagagcacaaaagtgctgcacatgacccacagatgcaaccgccagtggctgccgccagcgatgatcgcttcacgcgaaagcttcgcgccatgcataaaaaacagcagagcgatagccgctgtcgtaatgccttcaacgacaggcacaaagccaccttccgccgggaaaaaagaggccagtagtaccacggtgataagtgtcagcgtgaaagggtcaaggatacgaaaaagtttcataaaaactcctgaaagtcggtgcagctattttgcgtttttcgctttgagaaataaaattgatttattgcatctatatatgaatctagtcgatgaactattcactgcgtcaactgcggatttttattaccgtcgcccaggccaaaagttttagtcgggcaggggacaggattggactgagccagtctgcggtcagtcatagcgtaaaagagctggagcggcaaaccggcgtcagactgttggatcgcaccacgcgtgaggtggtgctgaccgaggcggggcaacagctggcgacgcgtctggagcgggtgcttgatgaactgaacagcatactgcgcgatgcaggcagagtagggacacaattaaccggcaccgtgcgcgttgccgcgagccaaaccatttctgcgcatcttattccgcaatgcattgcccaaagtaattcactttatcccgctattgattttgtattgcacgatcgtccgcagcagtgggtgctggagagcatccgccagggtgaagtggattttggcatcgttatcgatcccggcgcagcggtggatttacagtgtgaagccatcttatcagagccttttttactgttgtgtcgccaggatcatccgctggcgcatcaggaatgggtgagctggcaggatcttaaacaggcctcgctggtcttacaggattatgcttccggcagtcgaccgctgattgatgcggcgctggcccattttgctattgaggcggatatcgtgcaggagattggtcacccggccacgctgtttccaatggtggaagcgggaatcggcatcagcgtgctgcccgcgctggcgttaccgctcccgcagggcagccacttacaggttaaacggctgacgcccgtagttgaaaggcagctcatgctggcgcggcgaaaaaaccgatcgctctccacggcggcgcaggcgttgtgggacgtggtgcgtactcaggccagcgaattaaccgccgcgagggcgaaagatccgctgtatcagctataaatatctatctgtccgtgtgtgaggtgcggtcttgccctgccatttttgacagggcagtgtgttaaaacaggtatttgatggaataaataatgccatcctgcaggaaggattctcctaacttattatcagcgtaacgatattgtactcctgcggtcaggtgaggagtcgcattccaccacagcgctactgcgccattaatgccatctttcccgccattgcccgcagcgtaggacgcatcgcggtcaaactcatactcattccagttcgttacgctgaatttctcactacccaacgagaagctatagccggccacccaacctaatacataaccattatcgcctgtgtagtaggtctgatcggtataacgtttggcaaagaagggtttaaaccagtaaccgttacctgtgaagttatagcctaaaccatagagaaacatgtcatcatggaaattagcgcgatgaggtgaaccgtacgtcccgtaggcatggagatagaggtttaatcctgtatcgcccagataaatacggttggtatttttaaaggtgtaacgctgttcgctgcttggtttagcgtggcggccattgtaaaaattttcccagtcgaagaacccgtacatttctccccagctaaaattcgctccgccttccagttccaggtacccaaaatcatctttatgggattttttactggttttttccgtggtgtctgatgtccagtcgaggtaatggaggccgatatcggcgaacccgcctttaaattccgcatgggtgagtgcgggaataatgagtaaagaagaaagcgtcagagtaagaatttttttcatagcatatttccctatgccgataattattaatgggttaattaaaaagaggcaatttataaatatgaaagcggcatattgttaatatgaagtgcaagcaaaaaccaatactgttttccctctgtattaatacagaagcgatctaaatctatcgatattaaatggctattgatgacacgtgaaaagtgtattggtcagcaaggggcgatggtcgttataaaaaggagtcaaattaaatccgatagaacaaggaaacttatgcctcacgctcttttttctcataatcctgagtattgtattgatattattcatgcacataaaccggcatttaccccgcgagtcgcgtttattttaggctccgggttgggtgctctggcggatcaaatcgaagatgcggtagccatttcttacgagaaattgccgggatttcccgtcagcaccgtacacggccatgctggtgaactggtgctcggccatctggcgggtgttccggtggcctgtatgaaaggccgcggacatttttatgaagggcgtggaatggcggtgatgaccgatgccattcgcacgttgaaattactgggctgtgaagtgttgttctgcaccaatgcggcaggatctctgcgtccggaagtggggccgggtagcctggttgcgcttagcgatcacattaatacgatgcccggtacgccgatggtggggccaaacgatgatcgttatggcgatcgcttcttctcgctggctaatgcttatgacgcagattatcgcgccatgcttcagtccgttgcggcagagaagggattccccctcactgaaggcgtatttgtttcttatccgggtccgaacttcgaaacggcggcagaaatccgcatgatgcagattattggcggcgatgtggtcggaatgtccgttgtccctgaggtgattagcgcacgtcattgtggcctcaaagttgttgccgtctcagcgatcaccaatctggcggaagggctgggcgatgtaaaactctcccatgcgcaaacgctggcggcggctgaactttcccggcagaactttatcaatctgatttgcggctttttacgtaagctggcctaaacacaatgactacggccccgtattggggctttatctcacggcaaggaataaaaaatgggtattacgtcccgcttaaaagtcatgtcgttcttgcaatattttatctgggggagctggctggttaccctgggctcttacatgatcaacactctggattttaccggcgcgaatgtcggtatggtctacagctcaaaaggactggcagcgattatcatgccgggcattatggggatcattgctgataaatggctgcgcgctgagcgagcctatatgctttgccatctggtttgcgcgggggcgttattgtacgccaccaccgttaccgatccccagacgatgttctgggtgatgttggttaatgcgatggcgtatatgccaacgattgcattatccaatagcgtttcgtactcctgtctggcgaaagcaggtcaggatccggtaacgtcatttccgcccgtgcgcgttttcggcacaataggttttattgttgcgatgtggacggtgagcctgatggggctggaactgagcagtgcgcaattatacatcgcttctggcgcatcgttattgctggccctgtatgcgctgacgttaccgaaaattccggtagccgagaagaaggcgaacaccacgcttgtcagtaagctcggactggatgcttttgttctgtttaaaaatccacgcatggcaatcttctttttgtttgcgatgatgttgggggcggtgctgcaaattaccaatgtcttcggtaatccgttcctgcatgattttgcccgtaatcctgagtttgccgatagttttgtggtgaagtatccctctatcttgctttcagtttcgcagatggcggaagtgggctttatcctcaccattccgttcttccttaaacgctttggtattaaaacggtaatgctgatgagcatgctggcgtggacgctgcgtttcggcttctttgcctttggcgatccatccccgtttggctttgtgctattgctgctgtcgatgattgtttatggctgcgcatttgatttcttcaacatctcagggtcagtatttgtagagcaggaggtggactcaagtattcgcgccagcgcgcaggggctgtttatgaccatggttaacggcgtgggggcgtggattgggtctcttttaagcggtatggccgtggattatttttctattgatggcgtaaaagattggcaaaccatctggctggtttttgccgcctacgctctggcattggccgttatttttgcattgttctttaaatatcagcaccatccagaaaaactgtcgaccaaatcattagcacattaattttatttgactggcgagaggatgttcgccagtccatttttatgaacaaggacacagtatgaaagaaattattctctcctccggtattggatttggtattggcgcattttttactttatgccgtatacctattcctgcaccaaatgttttacccggggttttatctattgtatttatgtatattgggtatcttgtcgttaaatctattttttactaggtaatatggtaaattccagacgttatcccttattcctggagtgcgatagtgatggaacgagcccatcgtattgatctaaagctattacgttatttcctcgctgttgcagaagaattgcattttggccgggctgctgcccggttaaatatgtcacaacctcccttgagtatccatatcaaagaacttgaacagcaactgggtacattgctgtttattcgtcattcccgcagcgttgcattaacccatgccgggaaagttttaatggaggagtcacgtcgcttgttagccaatgcaaatcaggcgctggcgcgagtggagcagattggtcgcggtgaagcggggcgcattgaactgggtgtggttggtacggcgctgtggggaagaatgcgtcctgcgatgcgtcactttttgaaagcaaatcccaatgttgaagtactttttcgcgaaaagtctccaggtatgcaaatggcgttgttagagcgtcgggaacttgatgcagggatctggcgtatggctatcgaaccagcagtcggttttaccagcatacgtttgcatgaatctgcattcatggttgcagttccggaagatcacgatctggcatccagagattctgtgccgctgtcggcgttgcgcaatgaatattttgttacgttgccttccgtacattctgattggggatttttacaacgtgtatgccaacaggcgggtttctcgccaatgattattcgggaagtggttgagccgcaaacggtgttggcgatgatcagtatggggatcgggattacgttgatggctgatggctatgcgcaaatgagctggccgggtgtggtgttccgtccgttagaggaacgtattccggcggatttgtatattgtgtatgaccagcagcaggcaacgccagcactggagaaactggtggcggcgttgacggtatgatgtctgtgccggatggcgactaacgtcttatccggcctacgcggcggtgtcgtctgtaggcctgataagcgcagcgcatcaggcaagacccgaacctgcggcaggttcgaatcttataaatcgcagatagcaaaaaagcgcctttagggcgcttttttacattggtgggtcgtgcaggattcgaacctgcgaccaattgattaaaagtcaactgctctaccaactgagctaacgacccgaagtggtgggtgatgacgggatcgaaccgccgaccccctccttgtaagggaggtgctctcccagctgagctaatcacccacttcggtacttcacaataagaaatttagctggcgagaaagtggtgggtgatgacgggatcgaaccgccgaccccctccttgtaagggaggtgctctcccagctgagctaatcacccacttctcaatttcttatctacacggcggagactacataaagtagttggtgggtgatgacgggatcgaaccgccgaccccctccttgtaagggaggtgctctcccagctgagctaatcacccccgctgtgtggagtcgcattatagggagagttgaaaatgagtcaacgcattttctaaagtttttgtttgttcgtcgtaaaattaaacaaaacgatcgtgaattaccccgcactgcatgatttctatacggaaatagcaaagcgcagcgttctgaccggatcaacattgaggaatcaagccacagtgatagaatacaaggctattcatctttccaggatttgccggttgtcggcatctttataaacgtaaggccatttcatgaaaatcaaaactcgcttcgcgcctagcccgacaggttatctgcacgtcggcggcgcgcgtactgctctttattcctggcttttcgcacgtcaccacggcggtgaattcgtgctgcgtattgaagacaccgatcttgagcgttccacgccggaagccattgaagccatcatggatggtatgaactggctgaacctggaatgggacgaaggcccatatttccagaccaaacgttttgatcgctataacgcggtgattgacgagatgctggaggcgggaacagcctataaatgctactgctctaaagagcgtctggagcaactgcgtgaagatcagatggcgaaaggcgagaagccgcgttatgacgggcgttgccgtcacagccacgaacatcatgccgacgatgagccatgcgtggtgcgctttgccaacccgcaggacggttccgttatttttgatgatcagatccgtggcccgatcgaattcagcaatcaggaactggacgatctgatcattcgtcgtaccgacggttccccaacctacaacttctgtgtggtggtggacgactgggatatggaaattacccatgtgattcgtggcgaagaccatatcaacaatactccgcgccagattaacattctgaaagcgttaaacgcgccggtgccgatgtacgcgcatgtgtcgatgattaacggcgacgacggtaaaaagctgtctaaacgtcacggtgcggtgagcgtgatgcagtatcgcgatgacggttatctgccggaagcgttgctgaactatctggtgcgtctgggctggtccagcggcgatcaggaaatcttcacccgcgaagagatgatcaagctgttctccctcggtgcggtgagcaagtctgcgagcgcgttcaacaccgataaactgctgtggctgaaccaccactatatcaatacgctggcgccggaatatgtggcgacgcatttgcagtggcatatcgagcaggaaaatatcgacacccgtaacggcccgcagcttgctgagctggtgaagttgctgggcgaacgctgcaagactctgaaagagatggcgcagagctgccgctacttctatgaagacttcagcgagtttgacgccgatgcggcgaaaaaacacctccgcccggtggcgcgtcagccgctggaagtggtgcgcgacaagctgtcggcgattacggactggtcagcagaaaacgtccaccacgcgattcaggccacggcggatgagctggaagtggggatgggtaaagtagggatgccgctgcgtgtggctgtgaccggtgccgggcagtcgcctgcgctggatgtcaccgtacatgcgattggtaaaacccgcagcattgagcgtatcaacaaagcgctgggctttatcgccgagcgtgaaagtcagcagtaacgccagctgaaacagaataaacggcagggcagacgcctgccgtttattatttgttagtccgcctcattgatacctaaacgcgtcagaaatccgcgaataccttcccgcgataaaaacagcgccagtttttcctgttcctgagcagacatattttcaacggcatcaataatttgtcgataagcgtgactgtgcgtcgcgttcgcatattctgcgaaagcctcttccgcctgataaaacgcaggcagtttgcgaaaagccggaatattgagaataaactcccgcacgctggcatcaatatggatgagtcttgcgcgtccgcctttgacgccgggaaatttttcggttttccagtgttgttctctgatccagcgattgacggtttgtctggccacgccgaggcattcagccagctcttcagtggtcattttactgcgtaatcttttcatattatttgctatcgcgtatccctaagcgttgtaacaaaccggtaatcccttcacgcacgaggagagaggtaaactgtttctgctcggatgaggtcatctctttggcgagcgtcatgagcagcgcttcaagcgatgcgttgctggcaggcgtgaatgtgtctgcgtgatggtcaactgaacgttcagcgctgcggatatattcacgaacctgttcgtttacatgaaccagacgggctttaccgccctggacgccaggtttgggcgatgttgcccagccttctttccgtacccatttattgatggtttgtcggctgtaaccggtgagattagcgagttcttctggcgtcatccgttccttgaacataacgattccctgaatagtcgtggggttaattagtggttcattttatagcaccattttagtcgaaaccgtgacgtgtttaactactgaatgcgagttgtgccgcaatgtcctttatttgaatgctttttcagcgattgaattcggcaagttcattttgccgttgacacatgccgagggaattcatatgatgccgcccgtcaactcgacaagctttacgtagtggggctatagctcagctgggagagcgcttgcatggcatgcaagaggtcagcggttcgatcccgcttagctccaccaaatttactcccgataaatttggcgtatacgtaaaagcactatggggctatagctcagctgggagagcgcttgcatggcatgcaagaggtcagcggttcgatcccgcttagctccaccaacgttcaaaccctcgctgaaaagcgggggtttttgctttttgtcacaaaattcatggcgtctgatctgctcttcaggtgcgttcgtttgccgctgcttttgcggtcaatatgagcttttgttagattgcttcataatgcgaatatacttattattcatgcgccttatataatgatgtgagcattaaagcaatgccggataagtgtaacgtattaaaaaatataaaaatattcttactggccttctgcctgaccgttccggctattctgctatctcgtctcatttctccccgcgccacaattgattccagctatatctttctggcctggctaccgctctgcgtcatgttttccgtgctgtttttatttggccgccgtggcgtcgcgccgatggtaggcggaatgatgttgactaatgaatggaattttcatttacctctgccacaggcgatggtgctgctattttgccagacgtttcccgtgttgctggtttgcgctatcgtacgctggcagctgggcgcgcgctggcgctacggaatacccaaccaaggcatctggctacgcgttttctggttagggttaatgacgccgtttggtataaaaatcagtatgcatctggcggggcactacctggctttcccggtgaccatctctaccttctttggcaccggcaccgctattttctcgattgtcgatttattgagtctgatttctgccgcgcttatttttaccctctttttctattatccgctgcgaatgatagtcagcccgcactatatgcgtattttctggcggagggatgtcgctccttatctcgccaaagaaaaacgcctgtttacgcttctctggtttgccactctggcgacgctattagcggtgctgtgtacgcctttcgagacaaagtatattgctggctatctggtgccagttctgttcattggatttaccatcggcgtggggaaaatcagctatccgctgttgaattttagttgggctctcactgcgctattcctgcttagctataaccgcaattttctgcagggcgtgggttcagaatattcgctggcatttatcctttcagttctcatttcttttagtatttgtttgttgtacatggcgcggattaatcagcgtagcgaatggttgaatcgacagtggcactcgcaggcattgaccgatccgttgacgcaactgcctaacttgcgcgcgctggggcagtttcttttacaggatgccgggcaaagcgtgtgttatctacgcatggaaaacctggaatttctgagccgtcattacggtatgcagatgcgcgtgcattgcgaacgcgaggtgtttcgcgtgttgcagccgctgctgctggaaaaggagaaaattttccatctgccgggcagtgaattattgctggtattgacgggaccggagacggaagcccgcctgcaatatatgctcaatgtgcttaataaccgcaaaatttactggaacaataccggtctggacatggaatacggcgcatcgtggggaacattcgatggtcgccaggaaaccttgcaaccgctgttggggcaattaagctggctggcggagcaatcctgctcgcaccgtcgggtgcttgcactgacccagagtattgaagccgcttccgggcagacgacggaacgggtgctgcggttgcagaaaatccgtcaggcgctggagcgcggcgcgctggttttgtatgcgcaacccattcgcgacgcgcagggaaaagggtatgacgagattctgacgcggcttcggtgcgacgacggtatcatgatgccgaatcagttcattccgcttatcgcccagtttaacctgagcgtacggtttgatatgcaggtgatggaagcgctcctgcaatggttgtccgcgcatccttcggcggagcagggggcgcgtttttcggttaatttgatgccgctgacgctgctgcaaaaagagacggcgtcgcgcattatgcagctttttaaacgctatggcgtcccgcctgcttcggtcatcatcgaaattactgaagaacaggccttctctcattccgaaatcagtatgcacaatatcaaccagctgcgtaagtttggcctaaaaatcgccattgatgatttcggcaccggttatgcaaactatgaacggctaaaacgcctcaaggcggacatcattaaaatcgacggttgtttcgtaaaagatattctgacggactccctggatgcgatgatcgtgaaatccatcactgatttagcgaaagcgaaatcgttgagcgtcgtggctgagtttgttgaaacgcctgcgcagcgcgatctgctattgcagcttggcgtacatagtttgcagggatatctgattggccgcccgcgcccgttaggcaaataagcggcataaaaaaaccggggatagctccccggtttctacattaaacgcagacttacagtaccagcgccgcgatagaggcggacagtacgctcaccagcgtagaaccgtaaaccagtttcagaccaaaacgggaaaccacgttgccttgctcttcgttcaggcctttaatcgcgcccgcaataataccgatggaagagaagttcgcgaaggacaccaggaagacggagataatgccttcagcgcgtggagagagggtagaggcgattttctgcagatccatcatcgccacgaattcgttggaaaccagtttggtcgccatgatacttcctacctgcagcgcttcactggacggtacgcccattacccatgcgaccgggtagaagatgtaacccagaatgccctggaaggagatgctgtagccgaaccaaccggtaaccgttgcgaacagcgcgttcagcgccgcgatcagcgcgatgaagccgatcagcatcgccgcgatgataatcgccactttaaaacctgccagaatgtactcgcccaacatttcgaagaaactttggccttcatgcaggttcgacatctgaatattttcttcgctggcatcaacggtataggggttgatcagcgacagaacgataaaggtgctgaacatgttcagaaccagcgctgcgaccacatatttagggtccagcatggtcatatacgcgcccacgatagacatggaaacggtagacatcgccgttgcagccatggtgtacatgcggttacgggacattttaccgagaatatctttataagcgataaagttctcagactggccgaggatcagcgagctgacggcgttaaaagattccagtttgcccataccgtttactttggatagcaggaaaccaatagcgcggatgaccactggcagaacacggatatgctggagaataccgatcaacgcggaaataaagacgatcgggcacaatactttcaggaagaagaacgccaaaccttgatcgttcatactgccaaagacgaagtttgtcccttcgttggcaaatccgagcagtttttcaaacatctcggagaaaccttttacgaagccaaggccaacatccgagttcaggaagaaccaggccagtaacacttcgataacaagtaactgaatgacgtaacgaatgcgaatttttttacggtcgctgctaaccagcagtgcgagtaccgcaacaacggcaagcgccaggacaaaatgaaggacgcggtccatatttgctccaaatatgaggcaggtttaattttcgtgcacattctatgcaacagctgtaaagaaaacgagatccaacacacactataataaggacctgtgacgagattcaaaattagtgatctgtaatacacttttactgtactgaatatgaaaatgaaaagttatatcagtgtgctaatcttgtaatgttaagccaaactgttctgatacaggtcgccatcgtatcggtctatcgtttcacactatcaaagtaatcacccgtacccattgaaatgcacttgataatcattatcaatgaacatagcatgaaacatagcaaaggctatgtttttgaggcaaaagatgactgacaatcgcgtagagaatagcagcggacgggcggcgcgcaagctaaggctcgcattaatgggacctgcgttcattgccgcgattggttatatcgatcccggtaacttcgcgaccaatattcaggccggcgccagctttggctaccagctactctgggtggtggtctgggcgaacctgatggcgatgctgattcaaatcctctcggcaaaactcgggatcgccaccggcaagaacctggcggagcaaattcgcgaccattatccgcgtccggtagtctggttttactgggtacaggcggaaatcatcgcgatggccaccgatttagctgaatttatcggcgcggcaataggttttaagctgatcctgggcgtctctttactacagggcgcggtattgaccggtatcgcgacgtttctgattttaatgttacagcgccgcggtcaaaaaccgcttgaaaaagtcatcggcggtttactgctttttgtcgccgccgcttacattgtggagctgtttttctctcagcctgatatggcgcagctcggcaaaggaatggttatcccggcgctaccgaacccggaagccgtattcttagccgccggcgtgcttggcgcgacgattatgccgcacgtgatttatctgcactcgtcattaacgcagcatctgcacggcggaacgcggcaacaacggtactcagcaacgaaatgggatgtcgctattgccatgacgattgccggttttgtcaatctggcaatgatggcgaccgccgcggcggcgtttcattttagcggccatactggcatcgccgacctcgatcaggcatacctgacgctggaaccgttactaagccatgcggcggcaacagtgtttggtcttagtctggttgcggcagggctttcctccaccgtggtagggactctggcggggcaggtggtgatgcaagggtttgtccgttttcacattccgctgtgggtacggcgcaccattaccatgctgccctcatttattgtgattttgatggggctggaccctacccgaattctggtgatgagccaggtgctgctgagttttggtattgcgctggcgctggtgccgctcctgattttcaccagtaacgctacgctaatgggcgagctggtgaacacgcggcgggtaaaacagattggctggataattgtcgtgctggtcgtcgccctgaatatctggttgctggttggaacggtgatggggttgtcataaagacagaaagatagcaggcccgatgcgtgggcgtcatcgggctgttattcagcaggaggcttagtgatgatgtttgtgaccccggcctcgcccgcgatgatcgtcgcgatcgcgccagccttcccgataaccgcgttcatacgctttacgcttatcccagccgcgatgatagccgttgtcatggcgccaccagcgatttttacgccattcataatggttgtgccagtaatcccggtcgcgccagcgaccaccgtcccagtagttaccgtaatcatcgcgatcgccaatctgtaattttattgagggcaacagggtgatttcgcccgcattcgcggcaagcggtgtaaaagccagcaaggctgccgccagaatcagtgacctgaacatactttctctccttcacgatcgagccgtcgccggcctgttaatgcaatattacaaagcagtaaagatttgtttcatcgccttaactcttaaatcatgaaggagagcattttttgctaaaaccggccctccagaatagcgtcaatttctgcacattccgccgccgaaaaacggcgattggccagcattcctacggcgtcttcgatttgcgacggtttgctggcgccaatcagtaccgaggtaacgttatcgttacgcagcacccaggcgagcgccatctgagacaatttttggccccgtcgtgcagccagttcattcaaccggcgaactttttccagtttgtcggcggtaatctgttctggtttaaggaaacggcttccgctcgccgcgcgggaatcttccggaatgccattcagataacggtcagtgagctgcccgcccgccagcggcgagaaggcaatactgccgacgcctttttcctgcaacagcgtcagcagcccgtcctctacccaacgctcaaaaagcgaatatttaggctgatgaatcaggcaaggcgtgccgagatcctccagaatatcgatagcttgtctggccagatcggcaggatagttagagatccccacgtacaacgctttgccgtggcgcacaaggtgatctaacgctttcatcgtctctttaagcggcgtttcgggatcgggacgatggtgataaaagatatcgacatactccagccccatacgtttcaggctttgatcgaggctggcgataaggtatttccgtgaaccccagtcgccataagggccatcccacatggtgtagcccgctttggtggagatgactaactcatcgcgccacggtaaaaaatcttcctgcagaatgcggccaaaattgcattctgcggagcccggcggcggcccataattattggcgagatcaaagtgggtaatgcccagatcgaacgcgcgttgcagcagcgcccggctattttctacccgtgtcgtatcgccgaagttgtgccataaccccagcgaaatagcgggaagtttgacgccgctgcgcccgcagcgacgatactccattgtgtgataacgattctcatcgggctgataaatcatgacctttccccctgtggcgtgaataaatagtgtatacggttacactcgccaggcggtatccggcttttactgtttgccgctgtaaacattgttttccaggctttcatccccgccgtgctggacagccatcggcattccttaatactcaacataatgtcaacgtcagaaggaaagctgtcatgcaaaacccctataccgtggccgactatttgctggacagactggcaggatgcggcattggccatctttttggcgtaccgggcgattataacttgcagtttcttgaccatgtgattgaccacccgaccttgcgttgggtgggatgcgccaatgagctgaacgccgcttataccgcggacggttatgcgcgcatgtcgggcgctggagcgctactcaccacctttggcgtgggagaacttagcgctattaacggtatcgcgggcagttacgcggaatatgtcccggtcttgcatatcgtcggcgcgccctgtagcgctgcgcagcagcgtggcgaattgatgcaccataccctcggtgacggcgattttcgtcatttttatcgcatgagtcaggcgatatccgctgccagcgcaatattggatgaacagaacgcctgtttcgagattgaccgcgtattgggtgaaatgcttgccgcacgcaggccaggatacatcatgctgcccgccgacgtggcgaaaaaaacggctatcccgcctacggaggcgctggcgttgcccgtgcatgaagcgcaaagcggcgtggagacggcttttcgttaccacgcccgtcagtgcctgatgaacagtcggcgcattgcgctattggccgactttcttgccgggcgttttggtttacgaccactgttgcagcgctggatggcggaaacgcccatcgctcatgcgacactactgatggggaaggggctttttgatgaacagcacccgaacttcgttggcacctatagtgcaggcgccagcagcaaagaagtacgtcaggccatagaggacgccgatagggttatctgcgtcggcacccgttttgtcgatacccttacggccggatttacccaacaattgccggcggaacgcacgctggagattcagccttacgcgtcgcgcatcggcgaaacctggttcaacctcccgatggcgcaggcagtgtctacgctgcgcgaactgtgccttgaatgcgcttttgcgccgccgccgacgcgttccgccggacagccagtgcggattgataagggagaactgacccaggaaagcttctggcaaaccttacagcagtgtctcaaacccggcgatattatccttgtcgaccaggggaccgccgcctttggcgctgccgcgctgtcgcttcctgacggcgcggaagttgtggttcagccgctgtgggggtctatcggctattccttgcccgccgcgtttggcgcgcaaaccgcctgccccgatcggcgggtaattctgattattggcgatggcgcggcgcagctcacgattcaggagatgggctcgatgttacgcgacgggcaggcgccggtcatcctgctgctcaacaatgacggctataccgtagagcgcgccattcacggcgcggcccagcggtataacgacatcgcgagctggaactggacgcagataccaccggcgctaaacgcggcgcaacaggcggagtgctggcgggtgacgcaggctatccaactggcagaggtcctcgaacggttggcgcgcccacaacgtctgtcatttattgaagtgatgttgccaaaagccgatctgccggaattactgcgtaccgtgacccgggcgctggaagcccgcaacgggggataatggcccccgctgcgccggattagggttcgtgacggttggcggccagcaacggttttcccgccagcaatagccaggcggggagcatcacaatgcagagcagcggcagcagattggtatccggtacgacgactgccgccataaacagactgagccagccgtcgcgcgtcactaccagcactaagccaagaatcgcgcaggagacggtaatcgccgcgggtacggcctcaacatgggcatggagcatgagccccagcgccgcgccgataaacacagccggaaaaatgcgcccgccgcgaaagccgctcgccgccgcgatgaccagcgcggcgagtttgacgacggctaaggtaaaataatctcccgcgcccaacgtctggctaaacgccatttgttgcatttcgtccaggcctttaaacagggtaagcggcccgccaatgacgcccagaatacccagtataaaaccgccaatgccgagaatcaggaccggattttttagtcggtgcagcaactcgtgcagacgcggaaggcaccagacggcgaccatcccggcggcaatggcgatcgccgcgacgatcgctccgctggcaatgtccaccagccgcatctgcgtgtaatgggcgatgggtaacgaaaaatgcggatgaaagaacaggctggtggtgagtgaccccgccgctgccgccattaacggcgcaaacaggcgatcccacatgggaatatcgttagagccgctaagcgtttgcgaaaaaatcagcgccgcggcgacgggcgtgccgaacagcgcgccgatggtgcctgctgaggccagaatcgtccagtctaacgccgtgatacgcggaaacaggcgggagccgaaagccgccgccagcgcgatatttattgtcattatcggatgctctggccccaaacttaccccaccagcaaggccgatgattaaggcgagaagcagcccgggcagcgcagatggcgagaccggcatactgattaacggttcgatggccggatcggggccagcgtgtccgggactgtaacggataatcaaacccaccacgatcccggttagcgtgagcatacccactatccagaacggcgaatcataagcgattccgatgctggcgggcagtcgttgccaaagaaattgctgaaaaaccgacgcgactttcatcgaggcgattaaaactaggcttgacgctacgccaataatcagcgcagggagcgacagcagcagcatcgttcgggcacgcgggtggaacataatctcttccttacacggggtcgtatatctattttgcacagcctgcccgacggcattgctgcaattggtgctgaaacaagaaagtaattctgtgatgaagatctatatttataggcagtcagcctgatggccgttgttgttatgcccccatgaatttacagtgtgacaaagacttattttgactttagcggagtagtagaagaatgacaaagtatgctttagtaggagatgtaggcggcacgaatgcgcgtcttgccctgtgtgatatcgccagtggagaaatctcgcaggccaaaacgtattccggcctggattaccccagtcttgaggccgtggtgcgcgtttatctcgatgagcatggcgtcagcgtggaagatggttgtatcgccatagcctgcccgattaccggcgactgggtggcgatgactaaccatacctgggctttttctattgcggaaatgaaaaaaaatctcggctttagtcatctggaaatcatcaacgatttcaccgccgtgtcgatggcgatcccgatgctgaaaaaagagcatttaattcagttcggcggcggcgaaccggtagacggcaaacctattgcggtgtacggcgcgggaaccggcttgggcgtggcgcatctggtgcatgtggataagcgttggattagccttccgggcgaaggcgggcatgtcgattttgcgcctaatagcgaagaagaagctatgattctggaaatattgcgcgccgaaattggccacgtttccgccgagcgcgtgctgtctggcccggggctggtgaatctttaccgggcgattgttaagtccgacaaccgtctgccggaaaatctgcgcccgaaagatattaccgaacgcgccctggcggatagctgtatcgattgtcgccgcgcgttgtcgctcttttgcgtcatcatggggcgatttggcggcgatctggcgttaaccatggggacatttggcggcgtttatatcgctggcggcattgtcccgcgcttcctggaattctttaaagcgtctggcttccgtgggggctttgaagataaaggccgctttaaagattatgtacacggtattccggtctatctgattgtccatgataatcccggcttgttaggctccggcgcgcatctgcgccagacattaggccatattctataagtcagacggcggcataaacgccttatccggcctacaaaagtgtgtcatctgtaggcctgataagcgcagcgtcatcaggcaatgaaacattctcttgtcagtctcaaaccgcgtgcctcacgcggttttttttcattgccgttcctgtgtatgaatacttcaactgactgaattatttcactttactcttgctgagcgaaaagtcaaacaccagcgcgttgagtcatcacgtcatggtgattactcaggcgaaaacagggatttattttactgtacgtatccggttcgctgccttatttacgctttcatcgcggcagcttgccggaaaggatccttattttcggggaaatatccctgaaaaataccgcaatatgacatgaacgaataccattatcgttagtaaggcttttgattaaagaggaaaaaccacaaaatcaaaaggggattatttgagataaggtttattgacaggaaattatcgtcggccataccgcgttaggtaaattcaatgatatcaatttgttaatgatgtgatttatttggtgctataactgacacgcttaaaaagtaaatttttacggttgttcctctttttcgtcgctaaaaaatattttcattagcctctcgacaggaagaaaattttcaggctattttctaaaggagccaccatcgtggcagcgtcgctcggacggtccgggcgctaacgttaatctgaggatattatggctgactcccgccctgaacgtcgctttacgcgtatcgatcgccttccgccctatgtttttaacatcaccgctgaactcaaaatggctgcgcgtcggcgcggcgaagatattattgatttcagtatgggtaatcctgatggcgcaacccctccccacattgtcgaaaaactttgcaccgtcgcgcagcgtccggatacgcacggttattccacgtcccgcggcataccgcgtttacgccgcgcgatttctcactggtatcaggaacgttatgatgtcgatatcgatccggaaaccgaagcgattgtgaccatcggttccaaagagggactggcgcatttaatgctggcgacgctggatcatggcgatacggttctggtgccgaaccccagttacccgattcatatctatggcgccgttatcgccggggcgcaggtgcgttcggttccattggtagagggggtggatttcttcaacgagctggagcgcgctattcgcgaaagttatccgaaaccgaaaatgatgattttgggttttccgtctaaccctacggcccagtgcgtcgaactggaattttttgaaaaagtggtcgctctggctaaacgttatgatgtgctggtggtgcacgatctggcgtatgccgatatcgtgtacgacggctggaaagcgccatccattatgcaggtgcccggcgcgcgcgacgtggcggtcgaatttttcacactgtcgaaaagctataatatggcgggctggcgtattgggtttatggtgggcaataaaaccctggtcagcgcgctggcgcgcattaaaagttatcacgattatggtgcttttaccccgcttcaggtggcggctatcgccgctctggaaggcgatcagcagtgcgtgcgcgatatcgccgagcagtataagcgtcgtcgcgatgtgctggtgaagggactgcatgaggcgggctggatggttgaaatgccgaaagcctcaatgtacgtctgggcgaaaatcccggagcaatatgcggcgatgggatcgcttgagtttgccaagaagctgctgaatgaggcgaaggtttgcgtttctccagggataggctttggtgactatggcgacacccatgtacgctttgcattaatagagaatcgcgatcgcattcgccaggccgtcagagggattaaaacgatgttccgcgccgatggcgtgctgccgtcacatccaaaacccgttgaagcgagcacggagtagaaaagcaaacaggagccccatggctcctgttttttgtctatggaaaacccccagctaggctgggggttccggaaagctttcagctttaagccagttattaaaaccccttttgatttgttaaaacatcttgcggtctggcaactgcaaaagttcaacaagaaatcaaaagggggtcccaatgggggacgaaaagagcttagcgcacacccgatggaactgtaaatatcacatagttttcgcgcccaaataccgaagacaagcgttctatggagagaagcgtagggcagtaggcagcatattaagaaaattgtgtgaatggaaaaacgtacgaattctggaagcggaatgttgtgcagatcatattcacatgcttctggagatcccgccgaagatgagtgtgtcgagtttcatgggatatctgaagggtaaaagtagtctgatgctttacgagcagtttggggatctaaaattcaaatacaggaacagggagttctggtgcagagggtactatgtcgatacggtgggtaagaatacggcgaagatacaggactacataaagcaccagcttgaagaggataaaatgggtgagcaattatcgatcccgtatccgggcagcccgtttacgggccgtaagtaacgaagtttgatgcaaatgtcagatcgtatgcgcctgttagggcgcggctggtaagagagccttacaggcgcatcagaaaaacctccggctatgccggaggatatttatttgcattgtacttttaaatcatcagggcgaaagtaccggcccaaacgatgaccataaatgaaatgcccataaagaaatatttcacgtttcatctctccgcgtacctgtcgtacgcctaaatgaacttacacttacctgattatagagagttgatgccggataatacgaaattgagaattattcgtgtttcgaccgcctgcatcacctcagaattctgcgcgtcatcgctccagacggcgctaatgtacgcctaaaaatgaggtgaaacaagaggcattttcttatttatttttagtaacttacaagtgtcgtgaatcggcgacagtttaatttctgacagtgatgaatcgctattgagcgacgccgccgacacagtaaaaaaacgcctgtaaacaggagacttatcgctaaaagcaggaatgagtaatttacgatgtgaatattatggcaatgcgaaatgacaaaataaaaggccttgcggcctttttcagatgtagagtgacgcttcccccaacgggcgagtcttgaaacggcgatgaatccagagatattgctccggggcgcgcatgatctctttctcaataattttattcatataggcagcggcttgattttcatctgccgggtaaccttccatttcaggggtaatatacagacgataacccgagttatcggatttccttaccattgtaacggtcagcatggcggcgccagacagcctggacagtacataggtaccgttggtggtggcgacgttttcaaccgcgaaaaatggcgcaaaggagctgcctttaggaccgtagtcctggtcgggagcaaaccaaacggcttcccctttttttagcgcgcccacaatgccgcgcagattgtttctgccgatcatcgctttatttgagcgcatacgaccgcgcgtctgcacccactccatgagcggattgttatgcggacgataggtcgccatcatcggctggcagagacccattacccggcctcccaattccagcgacataaaatgcacgccaacgaccattacgccgcgattttgcgcctgcgcacgggtaaggttgtccagcccgtccacatcaaaccatttgcgaacccggctatcaggccagaaccaggccatgcccgtttcaagcagcgccatgccaagagagtggaaattctcggcgatcagtttttccctttcttcccgggagagggtcggaaaacagagttcaatgtttttctgagcgatcgactcacgtcgcttcaggaaggggcgcgccagcttaccggtgcgggtgcccagaaaacgcaaaaccgggtagggaagctgcaccagtaaccagaggacgccaacgccaaaccacgtcagccagtagcgcgggtgcaaaaacgcgcgtgaaaatttgctttgaggaaacataaaataccttctgtagatacgaaaataatgtatcgcagaagagtcattatccgcagcggtacactctgaaatacgcatcatccttcaagttgcgttcgcttatccgaagcacttacttgagtaagctcatcagggtaacttgaatgatttgcgtatagttaggccatcatgtacgacaatggttcccgtaaggagtgtaaaactaagtcagtactaaaccacgagggcatgaacgccaggcaggctaatgtaccaccagttatttactcgcgcccagaaattctttatcaagaagcgtaaatatttctcccgtagcaaaaataagctaatcattatttttaatgcattgtttttacagtgataattttatttcagacgaaggttattgaaaaatgattagaaaataaaatgtgagataaatgttatggaaatgacgtgctgataaggtttatcttaaaggagaagtgagagggaccgtaaggctatatggaagccttgccatagacaggaggtattatagatgatctatttatggacatttcttgcaataagtatacttgccgtgagtggctatatcggtcaggtgatgggggctttttctgcggtttcttcttttacgggaatggttatccttgccgcgctgatttatttactcaatgtatggctgcaggatggcgatgacatcgttagcggattattgctttttctcgcaccggcatgtgggttaattattcgctttatggtgggatacggtaagcgttagtcagtacatacctttcatacttcaagtggcttatgtgttggctatggattactcggcccattcatgggcctcgccctgacgggacgtcgctcaccccagtcacatcgttatctatgctcccggggactcactcccttgccgcttttaagcaactcgaattatttttggtatacacgatgtcagcgaatagatagcgccgacaatgtcggcgcttctgttccccgggaaggctaatcgtttattgcgcgtccgcaagctgcagtgagtcctgattatgtaacgcattctggcgctggcgttccagttccagcgcgccgcgatgggagaggtaacagaatagaatgcagcacacgatgccgcccatcagaagataaaatccgccgtaccagcccagtttatccaccatgacgccaaacaggctggtgcccaacgaggcgccgaaaatatagctcatgaacccacgtaaaccgacggcggaacctacggcaaagctggggactatctccattgtctgtacggacgcgaggaattgcgggacgtaaatcagacaacctacaatggcggcgaaaatcgttaccatcagcaaagattcacttttccagtatccgatcagacagacaaaaatcagcgccatgcaaatcatggctaacggcattctgcggcccttaaacagtttatctgacagccagcctgccagtagcgtagagggaattgccgcccactcgaaaaagagaaacgcgacgctcatctgttcttttgaaaagtgttttactgtcaacagatagataggcaaccagctaatcatgccaaaccgcaccatatagacgaagacatcgaccagcgaaatataccaggcatttttattgcgcagcacataagtacagaagatttgccatgcgctcatattttccggcgcttttgccgtattcttcgttttcagtatgactttttcttccggcatcatctgttccagggagggaagaccttcttcgcgcggcgaaccttttcccaagaccagaacaattaaggcaaaaatgacggcgacgcaggccggaacgatataactggcgctttgccagtgttcgctgcccaatatcgcaaaagccgcaccgacgataggcgcgacgatcccgccgccaacgttatgcgagatattccagaaggcgcctacgcgtccgcgttcccgacgagggaaccagtttgcaatagtaataaacgaggggccgacgcccatgccctgaaaaaggccattgaagaccaccagagcggcaaatatccagaatgcgctactgaatcccagcccaacgttaacaatcacgcagagtaccagaccgcacgccatgaagacttttgggctggctttatccgccagactgctcattacgcctttactgattccgtaagcaataagcatacagctactcagcaggccgatttgcgtagcgctgagatccaattgctcttttaaataaggcgtcgataatgtgaagttgtttctgactatatagtaagcgagatatcccagaaatacgcttaacaatgcctgtatacgatatcgaccatacgtagcctggactttttccggtgggactttatgcgccgatcgccctgtttttaatattgttaacatggagtcacctgtattttatagtgagatgaacatcaggaggttttgtcggtagagtgaaaggagtgacaataaaattcaagtcgaggaaatgtgtcaaaattgactcaattgggtgaatttaaaggttatttttgacccatcctgaagggtgtggtgaaactttaattattggcatggccgttttatcgttagcatgtgcggatattaacaaatttgctgccagtgatctgatacgctttattgatgttttcgggcgacggacccgttattattcaaataacgttgttctggatgccaacagaaataaaagggtaagttttgtctcaatattttctttatgtgatatcgatatttatgaacgggatcacaaatcgacttttctcatactgtggttgtttcgccagagtgggcgcttttacgctatggctggcggcgatgttcggttcttgccaggcgtacagccgcgagctggtgatggcaacgaccttttcacccagcgcgaccgcctggattatccagcgctggcagacggagccgggttccgtcatgattcgtacgctcaaccgtaccagcggttctttagagcaattacttgatacggcgaatgcggaaaatgtcgatctgatcctgacgtcatcccccatgctgttgcaacaccttcaggagcaccaaaagctggcgctattggatagcgcgcctgccgccagccagaagctggtgccgcgttctatccgctcaacttcagtggcggtagcggtatccggatttgggctattgatcaaccgttcagcgctcgctgcgcgccatcttccgccgcctgccgactggcaggatatgggcctgcccagttaccagggcgctctattaatgagcagtccgtcacgctcagacaccaatcatttgatggtggagtcgctgttgcagcaaaaaggctggacggcagggtgggcgacgctgctggcaatctcgggtaatttggtcacgatttcctctcgcagtttcggcgtagcggataaaatcaaaagcgggcttggcgttgccgggccggtcattgataactatgctaatttgctactcaacgatcctaatcttgcttttacctattttccgtattctgcggtgtcgcccacttacgtcgcggtgttgaaaaacagccgtcatgcagacgaagcgcgtgcttttattcattacttattaagtccgaaagggcaaaggatactggctgacgcgaataccggtaagtatcccgtcgcaccgcttagcgccgataatcctcgcgccgcgcaacaacagcgtttgatggcccagccgccgttgaactatcgtctgatcctgaagcgtcagcaactggtacaacgcatgtttgataccgcgatcagttttcgtcttgcgcagcttaaagatgcatggcgagcgttgcacagcgcagaaacgcggcttaaacgccccttacctgaaatcagagccttattgaccagcgtcccggtggatgcggcaagcagcgaagatgaaacctggctggcgcagtttgataataaaagctttgccgaacaaaaaatgatggagtggcagatctggtttctgaacaatcagcggctggcgattcacaaactggaagagctgaaatgaaggggagattattgcaacggcttcgtcagctcagtatcagcaacagtttacggggtgcatttttaacgggcgcattactgacgctgattgtcagtatggtcagcctttattcctggcatgagcaaagttcgcaggttcgctattcgcttgatgaatattttcctcgcatccactccgcttttttaattgaggggaacctgaatctggccgtggatcaactcaatgaatttttgctggcgccgaacacgacggtacgtttgcagttacgtacgcagattattcagcatctggataagattgagcgtctcagtcaggggcttcagcttgctgagcgccggcaactggccgtcattttacaggatagccggaccttgctggcggagctggacaacgccctctacaacatgtttttggtgcgggagaaagttagtgagctttccgctcgcatcgactggctccatgatgatttcaccacggagctaaattcgctggtacaggattttacctggcagcaagggacgctgctcgatcaaattgaggcgaatcagggcgacgcggctcagtacttgcaacgttcgcgcgaggtgcagaacgagcagcagcaggtatataccctggcgcgaattgaaaatcagattgttgatgacctgcgcgacagattgaatgagctcaagtccggcaataatgacgggatgctggtggagacccatattcgctatctggaaaacctaaaaaaaacggcggatgagaatattcgtgcgctcgatgactggcccagtacgatcacgctgcggcaaaccatcgacgaactattggaaatcgggatggtaaaaaataagatgcccgataccatgcgcgattatgttgcggcgcaaaaagccttactggacgccagccgcgccagagaggctacgctagggcgctttcgcacgctgcttgaggcgcagttaggtagtagtcaccagcaaatgcagacgttcaatcaacgcctggaacagattgttcgcgttagcggcgggcttattttagtgacgacgctcctggcgttgctactggcctggggactcaaccactattttatccgttcccgactggtgaagcgttttaccgcgcttaatcaggctgtggtacagatagggctggggagaaccgactcgactatcccggtttacgggcgcgatgagctaggacggatagcccgcttgctacgtcatacgctgggccagctcaatatgcaacgcaggcagcttgaacaagaggtcgccgagcgcaaagagatagaagccgacctgcgcgccatgcaggatgagttgattcagacggcgaaactggcggtagtcggccagaccatgaccacgctggcgcatgaaattaaccagccgctgaatgcgctttcaatgtatttatttacggcgggacgcgcgattgaacaaggtcagagcggacaggcgagaaatacgctcaccaaagcggaagggctcattaaccggattgacgccattatccgttcgctgcggcagtttacccgtcgggcggagctggaaacgccattgtatcccgttgatctgcgccaaaccttcgtggcggcatgggagttattagccatgcgccaccaatcccggcagggagcgctttcactgccaaccgacaccgtatgggttagcggcgatgaagtgcgtattcagcaggttctggtgaatgtgctggcgaatgcgcttgacgcctgttcgcatgatgcggcgatcgcggtgacatggcagacgcagggagaggcgctggaggtttatattgcagataacggccctggctggcctggggcgctgttgccctctttactcaagccgtttaccaccagtaaagctgtcgggttgggtattgggctgtcgattagcgtgtcgctgatggcgcaaatgaagggcgacctgcgtctggcgtcgacgctgacgcgtaatgcttgcgtggtgctgcaattctcggtaacggatgtcgatgatgttgaatgatgaatgttctattttgctgattgatgatgacgttgatgtacttgacgcctatacccaaatgcttgagcaggcaggctaccgcgtgcgtggctttacccatcctttcgaggccaaagagtgggtaaaagcggattgggaggggatcgttttgagcgatgtgtgtatgccggggtgttccggtatcgatcttatgacgctgtttcatcaggatgacgatcaactgccaatcttattgattaccggacatggcgatgtaccgatggcggttgatgcggtgaaaaagggcgcctgggattttctgcaaaaacccgtcgatccgggcaaactgttgatattaattgaagacgcgctacgccagcgccggtcggttattgcacggcggcaatattgccagcagacgttacaggttgacctgattgggcgcagcgagtggatgaatcagtttcgacaacggttacaacaactggcggaaacggacattgccgtatggttttacggtgagcatgacacaggacgtatgactggcgcccgttatctccatcagctggggcgtaacgcgaaagggccgtttgttcgctatgaactcacgccggagaatgccgggcagttggagacattcatcgaccaggcgcaaggaggcacgctggtgttgagttatcccgaatatctgacacgcgaacagcagcaccatctggcgcgtttacaaagcctggagcatcggccttttcgtttggtgggcgttggcagcgcttcgctggtggagcaggcggcagctaaccagatagcggccgagctttactactgtttcgccatgacccaaatcgcctgccagtctctttctcagcgaccggatgatatcgagccgttatttcgccattatcttcgaaaagcctgcctgcgactcaatcatccagtgccggaaatagcgggggaattactgaaaggaataatgcgacgcgcctggccaagcaatgtgcgcgaactggccaatgcggcggagctttttgctgtcggcgtgctgccgctggcggaaacggtcaacccgcagttgcttctgcaggagccgaccccgcttgaccggcgcgttgaagagtatgagcgacaaattattaccgaagcattaaatattcatcagggacgaattaatgaagtggcggagtacttgcaaattccccgtaaaaaactttatctgcgcatgaaaaaatatggtctaagtaaagagcattataaattctgatattacagttactttcaatctggctgacaacaacagcaacgatgtcgttagccagataacgtcgcattaccgtaatggtaaatcattccattatgattatagattgcttattattcacctgagcatcaaattctatttcttaacttcaatataaggtaaaaatgcgtcaagttctctggcgtaataaatgtactcttgtccgacgatttgacaagatgaaaacttcatcacctctccagattacatctgaatatgaggacaagagaaatgaaaaaacatgctattgcagtaatgatgatcgccgtattttctgagtcggtttatgcggagtctaccttatttattccggacgtctctcctgagagcgtcacgacatccctttctgtgggggtgttaaacggtaaatccagggagctggtttatgataccgacaccggacggaagctgagtcaactggactggaaaataaaaaatgtcgccacgttgcagggggatttatcatgggaaccctattcgttcatgacgctggacgcccgcggctggacgtctttggcgtcgggatcgggtcatatggttgaccatgactggatgagcagtgagcagccaggctggaccgatcgttcaattcatccggacaccagcgccaactatgctaatgaatacgatttgaacgtgaaaggttggttattgcagggagataactacaaggcgggcgtaacagcgggctatcaggaaactcgttttagctggacggcaagaggcgggtcttatatttatgataatggtcgatatattggtaactttcctcatggcgtgcgcggtataggttatagccagcgtttcgaaatgccctatatcgggctggcgggtgattatcgtattaatgactttgagtgtaatgtactgtttaaatacagcgactgggtaaatgcgcatgataatgacgaacactacatgcgaaaacttaccttccgtgaaaaaacggaaaattcacgatattatggcgcgtctattgacgccggatattatattaccagtaatgcaaaaatctttgctgagttcgcttacagtaaatatgaagaaggtaagggcggtacgcaaatcatagataaaaccagcggtaatacggcgtattttggtggcgatgccgcaggtatagctaataataactatacggttaccgcggggttgcagtaccgcttctagaccacatcgggatgtcatcggtcataaccggccgatgacgactttttgctgaacgtgtggcatgcccggtgatattgtgtttacctcatatagatctggcgagtttggcgttaagacgtggcaaggaacagtagagggggacctcatccagatgttataaacttcaattcagaaagttactttccatatactctttgtgggactgcttcaacctttgggcagatatcggaaatgaaaaagatagaccaggcgactattcgctatcagaatatccggtacaccaactaccaacaaatcatttagtcgatggtctcgttgccattggttcatagagtgttggtcttggtatggatggctggggaagttatgtatcgaacattcttatgcaagattgcgcagggtctggtggtctatggtacacatatgggaagacattcacatatatttctgtaatcgatactaaaactttaacactaactaattgtttgtagaaagtggttgcattattaatggtttgagactcattgacataaaacaaacaccatctggtaatctgtcagaccccgcatcctcaacagttaactataaagattgtatggtagctgagatgtcattagtcctaatatcgtgtcagataaatttataaaagattactcatgttttgtgtcacatgcaaaaataattcggcttcgttaaggtctttaggggaaatacctaatggataattagttagattaacgttaacaacactttgaacgtgtaatgaatatgggggtataatataagtattgggagattgtaattaaaaattatgtaattatctgattattatatattcactccagcaaaggagaaaggcaattatggacgaaaagaaactcacagctcttgcggctgaactggctaaaggtcttaaaactgaagccgacctcagtcagtttttccatatgctgacgaaattaaccgtcgaaacggcgctcaatgctgagctggctgaccatctcgggcatgagaaaaatgctcctaaaacgagctcaaactcccacaatggctactcattaaaaacggtgctgtatgatggcggcgagatagtgctgaacatgctgcgtggccgtgaaaatacctttgaactgtagctgattaaggagcatcagacgcgtattacgagatggaaagtcagatttatccctttatgccaaaggcatgacatgactacccgcgaaatcatcgccaccttcaaagagatgtacgacgctgatgtgtcgcccatgctgatacttaagatcaccgccgcagtaaaagagttggtcaaaggggcgtcaaaaaatggagtatgccgatccaggactggtcgctggcaatgattcgctttattatcgagttcggtgaccgcctgagcgatcaccgttaatatagtggcagttacacagtatgactggcatgttccatattggatttatatgtaatagtaacagcctatctatttgattattttatttccaattttattaaaaaggaaatcagaaccaggctttgttaaatgtccccaatcaacggcagtgataaaatcaggaccattaccaactcttgtaagacatccactttcgttacataatgctttgtatgctgatatatattcaattcccatttttggaacattgttactaaagtaagagtcccactcgcttatttcactatttaatccatatgtcatatacaatggtggagtttttttaaactcactcaggtagttagatattattttaactaaatttgcattccattccgggactggtccaatgaaaacaatccttgagtcaggggatgcctctttaatttttttaatggttaatgataacgcatcaattgctaactttttatcatgtactccatttgttcctcgaactgaccatgtcagcagaaccacctcaggctgaacacgtttaatttcattaattctattattgtttagagtgatgacacttctctgtaaatcatctttaccgtcaacaaatagaggaggagcattaccatctgtcatttggcttattatataatcagaacctttattatctatataatgagaaagcccattgaaaagagccgccgcataagaatcaccaatgataaatatattatgcttgccattttttatacatccattggatatggcagcagtaagttgtactgagtgacatatccctccacggagtagttctccatatttataataattgtacacgtcagtaacagaagcatattcacttgctgatttattgatttccctgtctttaactccatttatatgaaaaataaatgcgccaattaaacccgtcccaaatacagataatgctaataatattgctgtgatatatttacttctggaatttctcagtggtttttcaattaaataataagttaatatcgccaaaaagaacgataataataaaagaagagttaattcatggtagtctggtgagccagcaaatattgaacgatagaatgaataaataggccaatgccacaaataaagaggatagctaataagaccaaagaaaacaacaggcctaacactaagcaatttcgacacaactaaatcattaccattagatgctattataagagaggcgccaagtattgggattattgctatatatccaggaaatgacatcttttcatctatcatggttattgataatgcgattagtataattcctaacagggacattaattttgataacgaagtgtttattcctataaatctcaatgtggatataatcgctccagccattaactcccaaaatcttgatgcgggagagtagtaattagctccgccatcagatgccattgtaaaaatgctaatcgcatagctaattataaatatagttgcgcatgataatactatgtttctgttatggtttttgcttctaaagcatagcaatataactactggccatattatataaaattgctcttcaattcccagcgaccacaaatgtagtaaaggtttaaggtatgattttgaatcaaaatagccagactcactccaaagagtaaagtttgatataaagaatgagccactaaaaacatgcttaccaagtaatttgtaatcatcctggaataaataaatccaaccaacaataagacatgatacaagaactatggataatgctggaaatattctaagcactctccttttatagaaatcaaggtatgaaaatgatttgtttgatgcagattttaatattattgatgttataaggtatccagatatcacaaagaatatatctactccaacaaacccacccggcaataatgatgggaaataatggaatattaccacagataaaaccgctattgcgcgtaatccatctatatcaggtctgtattttaagtgttccaacttaaattacctcaatttaaaaaaagattaataaaatggttgtgcatcttgcatcattcccgaagtttcgtgtaaacgaaaacggaatgacgagtggatcagatacggctattattttaattattgactccgtcacatctttacttccgtcattaataaaaataatctcaactttatatttttcaagttcattaaactcatgtaccgttctatagaaaatcggtatcgtgtcttcttcgttaaaaaccaggacgacaagagagattttcatttttatccctgaagataatgaatctggaatagataaagccgcataccaggctaattgccgagaaagtgatgagggtaaccaatggtggcaaagaacattggtcagccatccatccaacaacagcgctcagtgttcccatgaatcccatatacatcatgtagagaattgcagtagtgctggcattaaaggtgaagcgcgcattggcatagaagctgaacgatacagcgataacaaaatcggaaaagttcgtcagcgcctgatgcgtatgcatcccatacatacagaaagcaaatactccccaatgaatgagcgtgttaagaacaccgatcgatgtgtacttagcgaataacttcaacattatgaaaattagccgattcagaaaggtctggagtgtagcactacaaattggtttgatcgatataagcgatcaataattgtatttttaatagttttaagctattgagttttaatatattgatcgatgttatcgatcaattggtattgctgattgccaagcgtcttggaataaaaacgggacatgtaaagctttacatcgtcttacaaggctttgcatgttttttcagagagaggtacttgaaagggtggaagtgctggggagagggggagcgttaaaaattctgtataattttagtaacataaaataaaaaagaatggcacatgtcccatcccttcgatttcgacaaagcacttaaagcccttcaggtccggccaggcattaacgggcaaagatggcatcttaacgccattaatcaagtatttaaccgactctaccctgtctgctgaacttgattcccatctggctcaggatgttgaggcaaaccgtaaaaatggttccggcaaaaagccattaaagccccaacaggcagttttgaactggcaactccgcgcaatcgtaacggcacttttgagccataattggtgaagaagcttcagaccccctgtacgacgagatcgagcgcaatatcattcgactgtttgcgctggagatgagttatcaggacatcggccgggagagtgaagatctttatgccttcagcgtttcaaccgccaccgtcagtgcagtaccgataaagtcatccctgaactaaaacagtggcaacagagcccgctggagaaggtttatcccgtcgtctggctggacgctattcattataaaaaccgtgaggatggccgttatcagagcaaggcggtttataccgttctggcactgaatctagaaggcaaaaaagaagttctgggcctatatctgtcggaaagtgaaggtgctaacttttggttaagttctaacagcgagaggggactttaaagggatgcttttcgttatgtttataggcactattcgctggagatcataagacatcaaaaacgctgcaacgccttgtgtggtgtgggtttgctgagattcgtgagaggtgggtaaaagaggtcatggtgtcccctgcaggaatcgaacctgcaactagcccttaggaggggctcgttatatccatttaactaaggggacaacgcggcgccagtatagcgttttttattcgccggagtaagtgtagcgccgcctgactggttaaaccgtcgccactcagcgctgtttttccgcttttttccgctcccgttccaggcgctcgccgcgtagcctcgcttcttccttacgcttattgctcatatcgttgcggatctgcgcgtggctcatcaatgcgaaaataaaggtgccgccgcagatatttccggcaagtgtgggaagggcgaagggccagaaaaagtcgctccagggcagcgtgccgttgaaaaccaaatacaaaatttcaacggaaccgacgacaatatgggtggtatcgcccagcgcgataagccaggtcatcaaaataatgaccacaatttttgccccgcctgcagcaggaaacatccataccattgtggcgatgatccagccagagataatcgcgttggcaaacatctccgttgggctatttttcatgacctccataccaattttgacaaaggcatcgcgggtctcttcatcaaatataggcatatattcaaaagcccacgccgcaaccccggtgccaataaggttgcccaataagactacgccccataagcgcatcagcaggccaacgttactcagcgtgggattttgcattaccggcaatacggcggtaacggtattttcagtaaataattgctggcgggccatgatgacaatgataaaaccaaaggtataaccgagattttccagtaaaaagccgccgggaacgccttcaagctgcacgtggaaaatccctttcgccaggagtgatgcccccatagaaagtcctgcggcaatggctgaccagagcaaagccatcgcatcgcgttccatctctttttcaccatcctggcgaatatgttcatgaatcgccatggcgcgggaaggaagacgatcttcatctacttcaatctctttaccgctttgtttttcttcgctttcaacttccaggtcactgctgtgccggttaattttatcgtcgttaaggctatccatgatgatccttgctgattaacacatattaataaagcgtagcggtttttcatttacccaggccggggcattctccgaaaaaataaaaataatcacgctcgtttttatctgtttcgttagaatagggccgtcatgttgttgcgttaccaggctatgctcagagcaatgagatcgcgcatatagacatcgtttgacgtgctgttaaaatcgctcacacctaaacaggcggatacggtagcgttccgtcatggatggcaatcagcgatagccataattcacagggagacatctatgaagcttcgcctgtcggcgctggcgctgggaaccacactgctggtcgggtgtgcgagttccggtacagaacagcaggggcgttcagacccatttgaagggtttaaccgcaccatgtacaacttcaactttaatgtgctggacccgtatgttgttcggccggtcgcggtcgcctggcgtgattatgttccacagcctgcgcgtaacggtttaagtaatttcaccggcaacctcgaagaaccggcgatcatggtgaactatttcctgcagggcgatccttatcagggtatggtgcatttcacccgtttcttcctgaataccttattagggatgggcggctttattgacgtcgcgggaatggcgaatcctaagctgcagcgcgttgaaccgcatcgctttggcagtacactgggccattatggcgtggggtatgggccttatatgcaacttccgttctacggcagcttcacgctgcgtgaagatggcggggatatggcggataccttgtatccggtgctctcgtggttgacctggccaatgtccataggaaaatggactatcgaagggatagaaacccgcgcgcagttgctggactccgatggtttgctgcgccagtcttccgatccttatattatggtgcgcgaggcatacttccagcgtcatgactttatcgccaatggcggaaaactcaagccgcaggaaaacccgaacgcgcaagcgattcaggacgaactcaaagagatcgactcggaataaacggcagtaaataaaaaggtgagcgcaatgctcacctttttgatccgtttcagaaagagattagaacgcgtagttaaagttagtaccgaacagccaggctttcccttcagattcaaactgataagggccttcattaattttcacgctctgaccatgcatataagagacgccaacgtcgacagacgcatctttgttaaaggcgtaagtcgtaccggcgctcagccagaaacggtcctgatccggaatagagatagaacggttttgcgctggtaccgggctgtcatcgaaggcgataccggtacggaacgtccagttgtcatcgtagtaataggtggtacccaacgcaatgcgataagcgtctttaaagccttcatgcttctcaaagagcgtatcgccggcggtcgattttgccttcaattcctggaactgactccagctggtataggccaggctatagtggatggcccactgtggcgccacacggttataaccggacacttcccacatttccggcagattcagcgtcaggtagcctgactgcgtcgcgccgccggttgccgttgggataggcaggttaaatcggtttatagcgatgggaagatcgctactgtagttgcctttaaagtcaattttgacttccgagcggtaggtcagcgcgtagcggttatttttatccagttcataaaggataccggcattccagccaaagccccactgattaccgttcaggtgggcaatcttggtgtcgctgagaatctgacccgcgaccggcgccagcgccggattctgtgccgcgaccaactggcctaaatcgcccgcaaaacgttcgattttcgcgcgcgcgtataccgcatcaaagccgaggccgaagctccaggcctcatttaagcgataagcgccgcttaaattcaggttcatggtttcaagatcggtcgtaccgccaaccgagccgccggcgtatgtgtcgttaaactctgtcgccagaccatagttagaggtaatagaagccccccagccaaactggtcgttaatcggggcgacaaaatggacgttcggcacccaggccgttggcgcgatgttatccgcatctaacgtccgacgagatggcgatgtcccgctaatattaacatcaggatcaatataaactgcgcccgctgaaaacgtcgggcggtcaaacatggtaattaacgccgggttgcggctaacgttacccgcatcatctgcgattgcgccttcacccgaataggcccggccaaggccagaggaagaaaattcgtttaactgaaagcccgcagaccaggcctgggtggagatgattgccactgcgactgcgagagcagactttgtaaacagggttttctggctcatgaccataacctcattgattatttttatacaaactatgttacatgctgtaacaggagcgcgaagtgtagggtctgcggtacgacttagaaatcagaccagtggcgagagtataggtctgaccagctagaatgttgcaagtatgtttataagttttttcaattgtgatcttagaaacgagatctggctggtaaaatcggcgggcttaacggtcacccgatcgcgtgatttttgttttagatcatttttaagtgtgatttcggtcacttaacgcgtttcccaccattaacgactggagaggcgaatgccgggagcgtaaaatatccccatcgtttatctggcaccctgggtgcaaatacagaggaaatctacaatgagtaaatgcagtgctgatgaaaccccggtttgctgctgtatggacgttggaaccatcatggacaactccgattgcaccgcgtcatacagccgcgtattcgctacccgcgcagaggctgaagagacgctggcggcgttaaccgaaaaagcgcgtagcgtggagtctgaaccttgccaaattacgccaacctttaccgaggaatccgaaggcgttcgtctggatattgattttgttttcgcctgcgaagcagaaacgctgatcttccagctcggcctgcgttaatccgttcattcacgacgcctccgtcatcatctggcggaggcgttttctttttttgtcgtttcccttcactgtgccttagctcccactttcttttctctctgcttggctaaatgtaaaaaattggttaagactgtgatcaggtcagaccactaatttatttttttacaggggagtactatgcgtcaggctttaccgttggtcacccgtcagggcgatcgcattgctattgtcagtgggttacgaacccccttcgctcgtcaggccactgcatttcatggtattcccgctgttgatctcggcaagatggtggtaggcgagctgctggcgcgcagtgaaattccagccgatgccattgagcaactggtttttggtcaggtagtacaaatgccggaagcccccaatattgcgcgcgaaattgtgctgggtacgggaatgaatgttcataccgatgcctatagcgtaagccgcgcctgcgccaccagttttcaggcggtagcgaatgtggcggaaagcctgatggccggcacgatacgcgcgggtatcgctggcggcgcagattcgtcgtcggtactgccaataggcgtgagtaaagccctggcgcgggtactggttgatgtcaataaagcccggacgacccgccaacggctgacgcttttttctcgtctgcgcttacgcgacctgctgcccgttcctcccgccgttgctgagtattccaccggtctgcgcatgggcgataccgccgaacagatggcgaaaacgtatggtattacgcgtgaacagcaggacgcgctggcgcatcgttcacatcagcgcgccgcgcaggcatgggcggagggtaaactggcggaagaagtgatgacgacctatgtgccgccgtataaaaacccctttgcagaagacaacaacattcgcggtgcctccacgctggcggactacgctaaactgcgtcccgcttttgaccgaaaacatggctccgtaaccgccgccaacagtacaccgctgaccgacggcgctgccgccgttattctgatgaccgaatcccgcgctaaagagctggggctgcgcccgcttggttatctgcgcagctacgcctttaccgctattgatgtctggcaggacatgctattggggccggcctggtcaacgccgctggcgctggagcgggccgggttgacgatggccgatctgacgctttttgacatgcatgaagcgtttgccgctcagactctggcgaacttacaactgctgggcagcgaacgatttgcccgtgaggtgtttggtcgtgcgcaggcgacaggggaggtggatgacgctaaattcaacgtgctcggcggctcaatcgcctacgggcatccttttgccgcaacgggcgcgcggatgataacccaaacgttgcatgaattacggcgtcggggcggaggttttggcctggtcacggcctgcgcggctggcggtcttggcgcggcgatggttctggaggcggaataatgactaccacatcagcttttatgcttagcgtgcgtctggataatgtcgcggttgtcgctattgatgtccctggagaaaaggtgaacaccctgaaagcggagtttgccgcgcaggtacgcgccatcctgaagcagatccgggaaaataaagcgttgcagggcgttgtttttatctcagccaaagcagataactttattgctggcgctgatatcaacatgataggccactgccaaaacgcgcaggaagcggaaacgctggcgcgtcaggggcaacaactgatggcggagatccaggcgttgcctgttccggttatcgccgccattcacggcgcctgtctggggggcggtcttgaaatggcgctggcctgccatcggcgtatctgtaccgatgacgttaaaaccgttctcggactgccggaggtacagttagggcttttaccgggatcgggcggaacgcagcgtcttccgcggctggtgggggtcagtaccgcgctggatatgatcctgacaggtaaacagcttcgcgccagacaggcgcttaaagccgggctggttgatgatgtggtgccgcaaactattttactggaagcggctgtcgagctggctaaaaaagaacgcctggcgcagcggactttaccggtccgtgaacgtatcctggcggggccgctggggcgcgcgctgttatttcgcctggtgcgtaaaaagacggcgcaaaaaacgcagggtaattatccggcgacggagcggatcattgatgtgattgaaaccggactggcgcagggcagcagtagcggctatgacgcggaagcgcgcgctttcggcgagctggcgatgacgccgcaatcgcaggcgctgcgcgctgttttttttgccagtaccgaggtgaaaaaagatcccggtagcgatgcaccgcccggcccgctgaacagcgtgggcatcttaggcggcgggttaatgggcggcggtatcgcctgggttacggcctgtaaaggcggtttgccagtacgaattaaggatataaatactcaggggatcaatcatgctctgaaatacagctgggatctgcttgaaacaaaagtacgccgccgccatatcaaagccagcgaacgcgataaacagttggcgttgatatcaggttcgaccgattaccgtggtttcagtcatcgtgatctggtcattgaagcggtgtttgaagatctgccgttaaaacaacagatggtggcggaagtggagcaaaattgcgctactcacaccatttttgcctccaatacttcttccctgccgattggcgatattgcggcgaatgcggccagaccggaacaggtgattggattgcacttttttagcccggtcgaaaaaatgccgctggttgaggtcattcctcacgcgtctacttccgcgcagaccatcgccacgaccgttaagctggcgaaaaaacagggtaaaaccccgatagtcgtcagtgataaagccgggttttatgttaaccgaattcttgcgccatatatcaatgaggcgattcggatgctgactgaaggcgaacgcgtcgaacatattgacgccgccctggtaaaatttggttttccggtggggccaatccaacttttggatgaggtaggaatcgacacgggcactaaaattattcctgtgcttgaggcggcgtatggagaacgttttagcgcgcctgcaaatgttgtcgcttcaattttgaatgacgatcgcaaaggtagaaaaaatggtcgcggtttctatctttatggcgaaaaagggcgtaaaagcaaaaaacaggttgaccctgctatttataagcttattggcgtgcaagggcagagtcgactgtctgcgcagcaggtggcagagcgctgtgtcatgttaatgcttaacgaagcggcgcgctgtttcgacgaaaaagtgattcgcagcgcgcgcgatggcgatatcggcgccgtgtttggtatcggttttccgccgtttctcggtggcccgttccgctatatggatgctctcgggccgggtgaaatggtggcgacattacagcgcctggccgcactttacggtcctcgttacgcgccttgtgaacaattagtgcgcatggcggagcgcagggagcatttctggacgaatggggaaactgaccagggaaattgaggtcaaagagaatatgaatccgcactgaatgcctccttagtggcgaaataataatcaaggattgactatacttacgccattgaggtaaaaaacagcgtttcattcggtgaatggataaggcacaatgccggccaccgcatttttgccgcagccaataggggcatgtggtaagcgtgttggtgaaactggttaacaaaagcggtgcaatatgcaagtttttatcatgcgtcacggcgacgcagccctcgatgccgccagtgattcggttcgtcccttgacctcttgtgggtgtgacgagtctcgcctgatggcgaactggctgaaaggtcaaaaagtggatatcgaacgtgttctggtgagtccgtttcttcgggccgaacagacgttagatgtggtcggcgattgtatgaatctgccgactcaggtggatgtcctgccggagctaacgccctgtggcgatgtcggtctggtcagcgcctaccttcaggcgctggccaatgaagagatcggatcggtgctggtgatctctcacttacctctggtcggatacctggtatctgagctttgtccgggcgaaacgccgccgatgttcacgacgtccgcaattgccaacgttacgcttgatgaaagcggcaaggggacattcaactggcaaatgagtccctgcaatctgaaaatggcgaaagcgatttaatctttgctgcctgataaggcgcttgcgccgccatccggcaattccgcatcagggtaattcgggcggttgccactcttccacttcaatcaacaccagcagcgcggcgtcgccgccgtactctttcggcgcctgatgaaaggccatcacatgcggatgctgcgccagccataacggcgtttgctgtttcagaatatgtttaccgtgtccatgcatgacgcaggcgcaaaaaatatgttcccgacggcaggcggcaatcagcgcccccagttcctgcttggcctgaagctgcgttaagccgtgtaaatccagaaacagttctggcgaatagtcgccgcggcgcattttttttagctcgaaatggctgacatcttcacggacatactttaccggcccttccgtattgagcagcggctggaactcatcagaaaaatagtggctggcgtccgcctgttcctgaattaaccttcgggtagggacttccgtgattttcttgcgcagtggccgatggacgatagtatcctgtttaatctttcgggtgccgaccatcagctgacggaacagcgcctggtcctcctcgctgagcgatgttttctttttcattcgtgggtctcgtctgatcttttgccttagtttacccgacccggaggatatccgaacggtcaaaacggatttttcgtattctcccgccgcgtcaatgctgatttatccctgtcttcgtggcaaactagccgccgaatttaatgcgagcatgccctggaggaatacgtggataaaattttcgtcgatgaagcagtaagtgaactgcataccattcaggacatgttgcgctgggcggtaagccgctttagcgcggcgaatatctggtatggacacggtaccgataacccgtgggatgaagcggtacaactggtgttgccgtctctttatctgccgctggatattccggaggatatgcggaccgcgcggctgacgtccagcgaaaaacaccgcattgtcgagcgagtgattcgtcgcattaacgagcgtatcccggtagcctacctgaccaataaagcctggttctgcggccacgaattttatgttgatgagcgcgtgctggtgccgcgttcaccgattggcgagctgattaataaccacttcgctggccttattagccaacagccgaaatatattctggatatgtgtaccggcagcggctgcatcgccatcgcctgtgcttatgctttcccggacgcagaggttgatgcggtcgatatttcgccggatgcgctggctgtcgccgagcataacattgaagaacacggtcttatccatcacgtgacgccaatccgttccgatctgttccgcgatctgccgaaagttcagtacgatctgattgtcactaacccgccttatgtcgatgcggaggatatgtccgatctgccgaacgaatatcgccacgaacctgagctggggctggcgtccggcactgacggcctcaaattgacccgccgtatcctgggaaatgcgccggattatctgtccgatgatggcgttctgatttgtgaagtcggaaacagcatggtacatctgatggagcagtatccggatgtgccgttcacctggctggagtttgacaacggcggcgatggcgtctttatgttgaccaaagcgcagttgctcgcggcccgtgaacatttcaatatttataaagattaaaacacgcaaacgacaacaacgataacggagccgtgatggcaggaaacacaattggacaactctttcgcgtaaccactttcggcgaatcacacgggctggcgcttgggggtatcgtcgatggcgtgccgcccggcatcccgttgacggaggccgatctgcagcacgatctcgacagacgccgccctggcacctcgcgctatactactcagcgccgcgaaccggaccaggtaaaaattctctccggcgtgtttgatggcgtgacgaccggcaccagtattggcctgctgattgaaaacaccgatcagcgctcgcaggactacagcgcgattaaagatgtttttcgcccgggacacgcggattacacctatgagcagaaatacggcctgcgcgattaccgcggcggtggacgttcttccgcgcgtgaaaccgcgatgcgcgtagcggcaggggcgatcgccaagaaatacttggcggaaaagttcggcatcgaaatccgcggctgcctgacccagatgggcgacattccgctggagattaaagactggcgtcaggttgagcttaatccgttcttttgccccgatgcggacaaacttgacgcgctggacgaactgatgcgcgcgctgaaaaaagagggtgactccatcggcgcgaaagtgacggtgatggcgagcggcgtgccggcagggcttggcgaaccggtatttgaccgactggatgcggacatcgcccatgcgctgatgagcatcaatgcggtgaaaggcgtggagatcggcgaaggatttaacgtggtggcgctgcgcggcagccagaatcgcgatgaaatcacggcgcagggttttcagagcaaccacgctggcggcatcctcggtggcatcagtagtgggcaacacattgtggcgcatatggcgctgaaacctacctccagcattaccgtgccgggacgtacgatcaaccggatgggtgaagaggtcgagatgatcaccaaagggcgccacgatccgtgtgtggggattcgcgcagtgccgatcgcagaagccatgctggcgatcgtactgatggatcacctgctgcgccatcgggcacagaatgcggatgtaaagacagagattccacgctggtaagaaatgaaaaaaaccgcgattgcgctgctggcatggtttgtcagtagcgccagcctggcggcgacgccgtggcagaaaataacccatcctgtccccggcgccgcccagtctatcggtagctttgccaacggatgcatcattggcgccgacacgttgccggtacagtccgataattatcaggtgatgcgcaccgatcagcgccgttatttcggccacccggatctggtcatgtttatccagcggttgagtcatcaggcgcagcaacgggggctcggaaccgtcctgataggcgacatggggatgcctgccggaggccgctttaatggcggacacgccagtcatcagaccgggcttgatgtggatattttcttgcagttgccgaaaacgcgctggagccaggcgcagctattgcgcccgcaggcgttagatctggtgtcccgcgacggtaaacatgtcgtgccgtcgcgctggtcgtcggatatcgccagtctgatcaaactggcggcacaagacaatgacgtcacccgtattttcgtcaatccggctattaaacaacagctttgcctcgatgccggaagcgatcgtgactggctacgtaaagtacgcccctggttccagcatcgcgcgcatatgcacgtgcgtttacgctgccctgccgacagcctggagtgcgaagatcaacctttacccccgccgggcgatggatgcggcgctgaactgcaaagctggttcgaaccgccaaaacctggcaccacaaagcctgagaagaagacaccgccgccgttgccgccttcctgccaggcgctactggatgagcatgtactctgatggacaatttttatgatctgtttatggtctccccgctgctgctggtggtgctgttttttgtcgccgtactggcaggatttatcgattctatcgccggaggcggagggctgctcactatccctgcgctgatggccgccgggatgtcgccggcaaacgcgttggcgaccaataaattacaggcgtgcggcggctccctctcgtcttcgctctattttattcgccgtaaagtggtaaacctggccgagcaaaagctcaatattctgatgacgttcattggctcgatgagcggcgcgctgctggtgcagcacgtgcaggcggatattttgcgccagatcttgcccatcctggtgattttcatcggcctctattttttattgatgccgaagctgggcgaggaagatcgccagcgccgcctgtatggattaccgttcgcgctgatagccgggggatgcgtcgggttttacgacggctttttcgggcctgccgcagggtcgttttacgctctggcgtttgtcaccttatgtggctataacctggcgaaatccacggcacatgccaaagtgcttaacgctacctccaacgttggcggcctgctgttatttatcatcggcggcaaagtgatctgggcgacgggctttgtgatgctggttggtcagtttttaggggcgcgaatggggtcgcgtctggtgttgagcaaaggccaaaagcttatcagaccgatgatcgttattgtctcggcggtgatgagcgccaggttactttatgatagccacggacaggagatcctccactggttggggatgaattaatgaacagtacgcaccattacgaacaattaattgagatttttaacggctgctttgccgaagaatttaatacccgtctgattaaaggcgacgacgaaccgatctatcttcctgctgacgcgcaggtaccgtaccaccgtatcgtctttgcgcatgggttttacgccagcgcgctgcatgagatttctcactggtgtatcgccggtaaggcgcgccgcgaactggtcgactttggttactggtactgcccggacggacgcgacgcgcagacccaaagtcaatttgaagacgttgaggtgaagccacaggctttcgactggttgttttgcgtggcggcggggtatccctttaaacgttagttgcgacaatctggaaggcgatattgagccggatcgcgtggcgtttcagcgccgggttcatgcgcaggtaatggcgtatctggagcagggcattcctgaacgtccggcccgcttcatcaaagcgctacagaattactatcacacgcccgaacttaaggcggaacagttcccgtggccggaagcgcttaattaaagccagcgccacgtttacaatgaggaaagaagatgatcgcggagtttgaatcacgcattctggcattaattgacgatatggtagagcacgccagcgacgatgagctttttgccagtggatacctgcgtggccacctgacgttagccattgccgagctggagagcggtgatgaccactccgttgaggcggtctatgccaacgttagccaaagtctggagaaagcgatcggcgccggcgaactgtcgccgcgcgatcaggcgttagtcaaagcgatgtgggacaatttgttcgacaaggcaaaacaataacgccgtggaccggaaggcgacgcttgccgccttccgctattgactggcccattacttcaccgcttttcccttcaataactttctcacccataaccgatttggatttaacgccgccagcgtaccggcatccagtggaatcggctcgttactcatctgcgccgccagaatttctgcgcataatggcgctgaacacaaaccacgcgatcccagcgcgccgagcataaataaacccggatacacaggcgcagacgccgccgacgttttattatcggctaaatcggcgtaatgcgtcagcgtggcgtggtaatccgggacattgcccaccatcggcagatggtcgcgggtggcgcaacgcacgccgcaacgggcgctgttgccgctaacgtcaacctctgtggcccagttcgcatccggaaaacagtcaagcagacgctgtcggttctgacgctgatcttcttcgcgccagacggtgctttcgtcgccccggtgatagctggcgccaatacagtgctgctgattatgcggattttgcggcgtcagatagccgtcgtagcataacacctgacgcaacgccgagagggcgggggtggtgggaatatgactgacctgccccccgacggcataaaccggcagcggccgggtctgatcaaaacggttaatctgatggccgttcgccaggacgacagtctcatggctggcggtttcacctgacgtaaagcgcagttgccagcgcgactcctgcgcaacgagcgacgtgagcgtatggcgaaagcgcgtttgtaaaccctgttcagtcgccagtgcgatgactgcgcgagttaattgttccgggcacagccagccgcctgccggataggtaattcctccgcagcgtgtcgtcacgccaaccgcctgttccgcctcttcggcattgagcgccgaggccagtccggcgggcagcgccagggacagcatctgggcaattttctgctggcttttctcatcccatccgagctgtgtcacgccgcaccaggcatgatcaaaagagacgggcagggcatcatacaggcgacgggcaaaggtgaatgcggtcgggaaaaagcgattaatggcggcgtcatgtttgctaaggagcggataaagcgcgccctgtcgattaccggaagcgccctgggcgggctgatcatctgcgcaatagagcgtcacctgccagccgcgacgcagtaacgccagtgataacagcgcgctggcgatgccgccgccaatgatcgccgtttcacgtttttcgcttccgctgcagtaaaaccagggcgcggaaagggtcggcatgaggtgttgttccatcactccacaaagcatctcgcgtttacgtccgaagcctttgtgtttttgcatggtaaaaccggcttcctgtaatccccgacggacgaaacccgccgaggtaaacgtcgccagcgttgcgccgggccgcgccagccgcgccatcgcgttaaacaggtttggcgtccacatatccggatttttcgccggggcaaaaccgtcgaggaaccaggcgtcgactgtttgattcagcgtggcgtccagttggtcggtcagctcattaatatcgccaaaccacaaatccagcgtcacccgaccccgatccagcaataggcggtggcaccccgggagcggcagcggccattgcgcctgcagctgctctgcccagggcgcgagctccggccagtgttggtgcgccagcgccagatcgtcgcgcgttaacgggaatttctcaaagctgatgaaatgtaacctttgcagcgtcgcctgtgggtgcgcagaacgaaagctgtcaaacgcctgccacagcgtcaggaagttgagtccggtgccaaaaccgctttccgcgactataaataatggatgtgaatgtacgggaaatcgctccgcaagacgattgccgccaagaaaaacgtagcgtgtctcttcgagtccattgtcattagaaaaatagacatcatcaaaatctcgggaaacaggtgtaccctcagcgttaaattcgagtgtggcgggttgtatggcgtattgtttcacgtaagttactcgtctgacgggcggtatcgcgatcttaacgatgtgtgcctgatggcgcaaatttccgtactaaatggctgatcggacttgttcggcgtacaagtgtacgctattgtgccaatcgaaacttaaaaatagtgcgaattacagaggtattgaatgaaacgtgcagtgattactggcctgggcatcgtttccagcatcggtaataaccagcaggaagtcctggcatctctgcgtgaaggacgttcagggatcactttctctcaggagctgaaggacgccggcatgcgtagccaggtatggggcaacgtaaaactggataccactggcctcattgaccgcaaagtcgtgcgctttatgagcgacgcctccatctatgcttatctgtctatggagcaggcagtggccgacgccggtctggcgccggaagtctatcagaataacccgcgtgtcggcctgattgcaggttccggcggcggctccccgaaattccaggtctttggcgcagacgccatgcgtagcccgcgtggtctgaaagctgtgggcccgtatgtggtgacgaaagcaatggcatccggcgtttccgcctgcctcgctacgccgtttaaaatttatggcgtgaactactccattagctccgcttgcgcgacctccgcacactgtatcggcaatgcggttgaacagatccaactgggcaaacaggacatcgtttttgctggcggcggcgaagagctgtgctgggaaatggcctgtgagttcgatgcgatgggggcactgtccaccaaatataacgatacgcctgaaaaagcgtcccgtacctatgatgcgcaccgtgatgggtttgtcatcgcgggcggtggcggtatggttgttgtcgaagagctggagcacgctctggcgcgcggcgcgcatatctatgcggaaatcgtcggctatggcgcaacatccgatggcgcagacatggttgctccgtctggcgaaggcgcagtacgttgcatgcagatggcgatgcacggcgtagacacgccgatcgactacctgaactctcacggtacgtccacgccggtaggcgacgtgaaagaactcggtgcaatccgtgaagtgtttggcgataacagcccggcaatttctgcaaccaaagcgatgaccggccactcgctgggcgcggctggcgtgcaggaagccatctactctctgctaatgctggagcacggttttatcgcgccgagtatcaacatcgaagagctggatgagcaggctgcgggcctgaacatcgtgaccgaaacgaccgagcgtgaactgactaccgtaatgtctaacagcttcggttttggcggcaccaacgccacgctggtgatgcgtaagttgtaagcctgactattacgttgtagtatcaacaatgaaacaggtcgctaatgcgacctgttttttcattcagggaacaacaaattatatggatattatataaatgccaactaatacattagataaaattaggcatagtttgagttgtgtggctgttttatttggtttgttcggcatttttgtttttgcctcattttcgccttcctatgcctggctttatttgggaggtctggctgcgccttttatatatagtattgtttttgtctacgcgattgccgcctggagtatttattcaaagtattatccgtttttatcattgggccgcttatcatttgtggaatgttttgttccggcgctggccctggtgtgccttaccgttctctacaatgtttttagtggcccggaaccctggatggccgagttatcaaggcaattttttcttcataaatttcttaacacgctggtgatgtgctttctggctcctgtggcggaggaaattatattcagagggtttttattaaacagcagtatcggttggggtcgatactcaagagtttccggtattattattacttcactcgcttttgcatttatgcatacacaatatctctttgcggtgacttttgtttatctgtttgttttttcatcgatattatgcgttgttcgaatgagaagccgtggactaatgataccgataacacttcatattttaaataatgcctgggttattttcggcttgctgttttcagcgacggaataagagcctgatgaaataggctctttaacctctccggtacgaacaagagaacgatggcggttcccttttttaatgcttctcatattccggcgcgacttttgctgaccaggcctcagcctgggtgatggcgcctgcgtcataaatcggctgttcataatccttatcagcatcccgaacgcggtaaattttccagcgtccctcttcccaacgggtataaacttccaggtggatgggcgttgactctgtagccaacagaacatccactttttctccgccgaggaaagggtgtgccttcccaacccgtaactgtggaatccactctggcgcatagtcctgcgcatacataaaataatctgcccctacaatctcctgttcataaagggactgtattagcgccaggcgatgaataacctctttagcaacgtaacgttgcattaaggcggtggtgtcgtcaggggtattcacatcgttcatgaacgtcgtcatccatgaggtatagaactgcttcacggcctgcgtactgtcgtgatgaggcgcagagcaactacaaagcaacaggataagcgcgacaagggagaacgttttcattaattcttcctgtagatggtatatgagggcctggctgcccggtagcccgggccggcccacatatcgcgttgtttaaaatctgaataccactctgcgccatcgtatatcgccatgtgaccgctcgggtttccgccagcgtaaggttgaataatgatgacgtcaccctcgcgcggcatttcataggtaccaatagcggtgaatccggcgcttcttaacattgggccataatctttcgcatgatatgtatgccccagcgtgataccgcccgcctgaattgcctttcgggtaaattccgcacaccggccttgagaatgagaacctgcatgcgttttggcataattaaccgccactcttttatcccaactcataatgattcctgttaataaaatacgtaatagcaattacgtaatgctttaacagtatttgattcgggaagcatgacagatcgtgctattactattttcaatataataagtttaaatatttattaattgttgagattgataagttaaagccaatttattcagcattaactattattctgcgatatcggcatcattttttatttgcatatcgccatagcgcgacggccagatctcctgcggcgtgatgcccagcgcgtccgcaataatccgttcggctctcggccaggaacgggtaaagacattgcgcagtgaatcaggtgataaaccggcctgacgagaaagatctctgagcgtaatacctcttttttccagtgcacttttaatatctgcacgatgccagtcttggctttttggttccattctgtaatcctaagaagatgtgttatcggcgccgatatttttaagataaaattagcgcatggaaaaggaagttactttctttttcacgctaagaatagtgccagaaagaaagcaaaatttcgcgaaaaagaagaaatatttttatttcatcaggggaaaggaaagaaaccgatggcaaaggaatggttcacggttaaggaatgtcttggcttaccggggtttccgggaagcgagcctgcggttcgcgaacgtttatataagtacagtgaagggaaagcgggggtcaggcgtaagcgtgttaaatcaaaggccgaggagtttcatatatctgttttccctctctatgttcatcgttatctggacgacagcggagaggaaccgacgccagaacccatttccttacaggaagcggagcctgaagatatctgggagatgatgttcaggttactgacgccagaacagcgcaagcaggtgactggacggtttaaggtgagagggatgaaagcggtctttctctttctgtttgatgacacgccgccgcgttgataccctggctgcaatttcaaggttgacaaatttcgcgtctcacaggcagacttcactttctacattatccttccgataatgcgtaagcgtttaacgttatccaacgcaccttaatcctgacgttcaggtagaggggggcgtggcctttccccgccttactctgcattctggagtaatgcatgacagcagttagccaaaaaacaacgaccccgtctgcggatttttcgctgttccgcatcgcctttgcggttttcctgacctatatgacgatcggcctgccgttaccggtcattccgctttttgtccatcacgaactgggctatagcaatacgatggttgggatcgccgtgggcattcagttttttgcgacggtactgacgcgcggctatgccggacggctggcggatcaatatggcgctaaacgatcggcgttacaggggatgcttgcctgcgggctggcgggcgccgcctggctcctggccgcgctgttgccggtttccgcgccggtaaaattcgcgctgcttattgttgggcgtttgatcctcggatttggcgaaagccagctgctgaccggaaccctgacctggggactggggctggttggcccaacgcgttccggtaaggtgatgtcgtggaacgggatggcgatttacggcgcgctggcggccggtgcgccgttgggcttgctgatccatagccactttggcttcgcggcgctggcggggacgacgatggttttaccgctgctggcctgggcattcaacggcaccgtgcgtaaagtgcctgcgtatacgggggagcgaccttcactgtggagcgtggtcgggcttatctggaaaccgagcctgggcctggcattgcagggcgtgggctttgccgtcatcggtacgtttatttcactttattttgtcagcaatggctggacgatggcgggattcaccctgaccgcgtttggcggtgcgtttgtactgatgcgcatattgttcggttggatgccggatcgctttggcggcgtgaaggtcgccgttgtctcattgctggttgagacggcagggttgctgctcttgtggctggcgccgacggcctggatagcgctggtaggcgcggcgctcaccggggcagggtgttcactgattttctcggcgctgggcgtggaggttgtgaaacgcgtacctgcacaggtacgcggtacggcgctcggcggctacgccgcgtttcaggatatctcctacggcgttaccggcccgctggcgggcatgctggccacgtcatacggctatccttccgtattcctcgcgggagcgatctccgcggtggttggcatcctggtgacgatattatcgttccggcgcggttaagaaaccagccagaaaagcgccagtacaattattagcgcgataaacaacaggcctggtcgcgcagacagatttttcacggtttcaatcatcggcgcaaacgggcggtagatgggttgaatagagagcggttcgagctcatccgcctcccgctctacgcgacgcaggaaaatatggttaagtaaatcctgcacctgcgcggtggtcagcaccgtttgcggctgaatttgataagtgtgttgggcatactctttgatcgctgtgagttcgtccggttccagcggttgttttaacgcagcttgcagcgtatgtagcgtaggcgcgtgttgtagtgacagcgtctgccgcgcctgtagccatgtcgccagatgggtaaactgttttgccgaaatgagctcgccgcttttcacgccggagagttccagcattgattgccagataagtttgtttgactcgccggtcgcggccgccagcttcgtcaccaactgattcaacgtattatgttcagcaggcaataatggccgatccgttgccggacgttgttgcggctgcggaatggaaagctgcccctgttgcaggagcgtcagcacgtttttgagttgatcgggcgtaagctggctaagcgcggtttgaccgtattgttgacggataaaatcgctgacggcctgacgattattcccgacgccaagcagctctgttagctgtgaaagcacctgacgattggcgtgattttgctgcgctacgcccagacgctgggtaagattctgttcagcggcggggaagtggcgcgacagtagcggcgcgtcattttttatccccagatcgtgtttcattccggcccatacttccgcgctttgctgctgggtcagtgaaatcaggcgcgtgatcagcctttccagtaccgtacgctgttgcatggaaagcggctgctcgctcgcagcggaaagaggattacgcccttcgcctggaggctgtgcaggggcgccggagatgggatgcataattaattatcctttaaccataaatctgagcaatatatgcttggcggccagattatggcacacttgtccggttaactctcgttctcaaacaggtacgacagtcgtgaaaattctcgttgatgaaaatatgccttacgcccgcgaattatttagccgcctgggtgaggtaaaggcagtgccgggtcgcccgatccccgttgaagaattgaaccatgccgatgcgttaatggtgcgttcggtcacgaaagtgaatgaatcgctgctgagcggcacgccgattaacttcgttggtactgctacggcaggcaccgatcatgtggatgaggcatggctgaagcaggcgggcatcggtttttcagccgcgcccggctgtaatgctatcgccgtggtggagtatgtgttttccgcgctgttgatgctggccgaacgtgacggcttttcgttacgcgatcgcactatagggattgtcggcgtgggtaacgtcggaagccggctacagaccaggcttgaagcgttgggtatccgcacgttgctgtgcgatccgccacgcgccgcacgcggggacgagggtgattttcgtacgctggatgagctggtgcaggaagcggatgtcctgactttccatacgccgctctataaagacggaccgtacaaaacgctgcatctggccgatgagacgctgatccgtcgactgaaacccggcgccattctcattaacgcctgccgcggcccggtggtggataacgccgcattgctggcgcgactcaatgccgggcagccgctgagcgtggtgcttgatgtgtgggagggcgaaccggatcttaacgtcgcgctactggaagccgtggatatcggcacgtcgcatattgccggctatacgctggaaggcaaagcgcgcggcaccacccaggtctttgaggcgtatagcgcgtttatcggtcgcgagcagcgtgtcgcgctggagacattactgcctgcgcctgagtttggtcgtattacgcttcacggcccgctggatcaaccgacgctgaaaagactggcgcatttggtgtatgatgtgcgccgcgacgatgcgccactgcgtaaagtcgctggaattccgggtgaatttgataaattgcgtaaaaattatcttgagcgccgtgaatggtcgtctttatacgtgatgtgtgacgacgaaacggcagccgccttgctgtgtaagctaggttttaacgctgttcatcacccggcacattaatgtcttcttaatgctccctgtcgaataatgcgacagggacgcttatgtatttctggagtaaatcaccatgtctgaaggctggaacattgccattctgggcgcaacgggcgccgtaggcgaagccctgcttgaaacactggctgaacgccagttcccggtcggtgaaatttatgcgttggcgcgtcatgaaagcgcgggcgagcacctccgttttggtggcaagtcggtcattgtccaggatgcggcggactttgactggacgcaggcgcagttggcgtttttcgttgccggcgcagaggcatcgactgcctggatagacgacgcgaccaatgcaggttgcctggtgatagattccagcggtctgttcgcgctggagcctgatgtgccgctggtcgtgccggaagttaacccgtatgtactggcggattaccgtaaccgtaacgtgattgcggtcgccgatagtctgaccagtcaactgctggcggcgctcaagccgttaatcgatcaggggggactgtcgcgcatcgccgtcaccagtatgttatcagcgtccgcgcaggggaaaaaagcggtcgatgcgctggccggacaaagtgcgaagctgcttaacggcataccgattgatgaagatgatttctttggccgccagttggcgttcaatatgctgccgctgctgccggatcgggaaggcagcgtgcgccaggaacgtcgtatcgtcgatgaagtgcgtaaaattttgcaggatgatggcgtgatgatctccgccagtgtcgtgcagtcgccggtgttctatggccatgcgcagatggtgagctttgaagcgctccgtccgctggcggcggaagaggcgcgcgaggcgttttcccgcggtgaagatatcgtactgtcagaagagacggattacccgacgcaggtgggcgacgcttccggcaatccacagctctctattggctgtgtgcataatgattacggtatgccggaacaaattcagttctggtcagtggcggacaacgtgcgtttcggcggcgcgctgatggccgttaaaattgcggagaagctggtgcaggagtatctgtactgatgtccggacagcaatcatcgccggtctataaaattgcgctgggtattgagtacgacggcagcaagtattatggctggcagcgtcagaatgaagtgcgcagcgtgcaggaaaagctggaaaaagcgctctcgcaggtggcaaatgaacctattaacgtgttctgcgccgggcgcaccgatgccggcgttcacggcaccgggcaggttgtccatttcgaaacgaccgcattgcgcaaagatgcggcatggacgctgggggtaaatgcgaatttgcctggtgacattgccgtgcgctgggtgaaaactgtaccggatgattttcacgcgcgatttagcgctacggctcgccgttatcgctatatcatctacaatcatcgactgcgtcctgcggtattagcaaaaggcgtgacgcattactatgagccgctggatgcagagcggatgcatcgcgcggcgcagtgtctgcttggcgaaaatgattttacctcgtttcgcgcggtgcagtgccagtcgcgcacgccgtggcgtaatgtgatgcacatcaacgttacccgccacggcccttatgtggtggtcgatatcaaagcgaatgcctttgttcatcatatggtcaggaatattgtcggcagcctgctggaagtaggcgctcacaaccagccggagagctggatcgcagagctgttagcggccagggacagaacgctggcggcggcaacggcgaaggcggaagggctatatttggttgcggtggattaccctgaccggtttgaccttccaaaaccgccaatgggcccgctatttctggcggactaatccgaatcgcacacccgaaacgtgtcgggtagaaaggcaaagacaaatatggacctgatctactttattattgattttattctgcacatcgatgtgcatctggcggagctggtcgcggagtacggcgtctgggtgtacgctattttgtttttgattctgttttgtgaaaccggcctggtcgtcacgccgttcctgccgggcgactcgctgctgtttgtcgccggggcgctggcttcgctggaaaccaacgatctcaatgtgcatgtcatggtggcgttaatgctgatcgccgcaattgtcggcgatgcggtaaattacacgattggtcgactgttcggcgaaaaactgttcagtaatccgaattcgaaaattttccgccgcagttatctggataaaacccaccagttttatgaaaaacacggcggtaaaactatcattctcgctcgcttcgtgccgatcgtcagaacctttgcgccgtttgtggcagggatggggcacatgtcctatcggcattttgccgcctataacgtcatcggcgcgctgctgtgggtgctgctctttacctacgccggttatttcttcggtacgataccgttgattcaggataaccttaagctgctgattgtggggattatcgtggtttcgatattacctggcgtcattgagattgtccggcataagcgcgctgcgtcgcgtgccgcaaaatagaaagtaactcaacggttcgaccacttttttatccaaagtttcgggctgttatgttttaatgtgcaacattcatggtctgttgggggcaaaaatggcattatgcgccccttataataaagctgactaaggttcaggcagaaaggtcaccaatgagctggattgaacgaattaaaagcaacattactcccacccgcaaggcaagcattcctgaaggggtgtggaccaagtgtgatagctgcggtcaggttttataccgcgctgagctggaacgtaatcttgaggtctgtcctaagtgtgaccatcatatgcgcatgtcggcgcgcaatcgcctgcatagcctgttagatgaaggttcccttgtggagttgggtagcgagctggagccgaaaaacgtgctcaagtttcgcgactccaaaaaatataaagacagactggcgtccgcgcagaaagaaaccggcgagaaagacgcgctggtggtcatgaaagggacgcttcacggtatgccggttgtcgccgccgcgtttgaattcgcgttcatgggcggctcaatggggtctgtcgttggcgcacgcttcgttcgcgccgttgaacaggcgctggaagacaactgtccgttagtgtgtttctctgcttccggcggcgcgcgtatgcaagaagcgctgatgtcgctgatgcagatggcgaaaacctcggcggcgctggctaaaatgcaggaacgtggtctgccctacatctcggtattgaccgatccgacaatgggcggcgtttccgccagttttgcgatgctgggcgatctcaacatcgccgagccaaaagccctgattggcttcgccggcccgcgcgttatcgaacaaaccgttcgtgagaagctcccgccaggattccagcgcagtgagttcctgatcgaaaaaggcgctattgatatgatagtccgccgtccggaaatgcgcctgaagctggcgagcattctggcgaagctgatgaatctgcccgcgccgaacccggacgccccgcgtgaaggcgtggtggtgcctccggcgccggatcaggagtctgaggcctgataactgaaaagggcagggccgcaggctctgcccttttgcttttcaccgtaaagaagcagcggaatcaatgaaaaacaaatctatacctcaagctgcgtcgcccctggcctcgtggctttcttatctggaaaacctgcacagcaagagtatcgatttaggccttgagcgcgtaagccaggtggcagcgcgtctggacatcctcaagcctgcgccgttcgtttttaccgttgcgggaaccaacggtaaaggtacgacctgtcgaacgctggagtcggtgttaatcgcggcgggataccgtgtgggcgtctatagttcacctcatctggtacgttacaccgagcgcgtgcgcgtgcaggggaaagaattagcggaatccgcgcataccgcgtcctttgcggaaatagaagcggcgcgcggcgatatttcattgacctattttgaatatggtacgttgtcggcattgtggctgtttaaacaggctaaccttgacgtggtgattctggaggtcgggttgggcgggcgcctggacgccacgaacattgtggatgccgatgtagcggtaattaccagcatcgcgcttgaccatactgactggctggggccggatcgcgaaagtattggccgcgagaaggccgggatttttcgtgcggaaaaacccgctatcgtcggcgaaccggaaatgccggcaaccatcgcggatgtcgcgcaggagaccggcgcgctgttgctgcgtcgcggcgttgactggcgttatgaggtgacagcgacccactgggcgtttaccgatggcgacggcacgcttgccggactgccgttgccgcaggttccccagccgaatgccgccaccgctctggccgcgctgcgcgccagcgggttgaacattgacgaacaggcgattcgcgacggtattgcgcaggctaccttgccgggacgttttcaaatcgtgagtgagtcgccgcgcgttatctttgatgtcgcccataatccccacgcggcggaatacctgacgggtcgtctgaaaatgttgccgaaacgcgggcgcgtgcttgcggtgattggtatgctgcatgataaagatatcgccggcacgttagcctggttgaaaagcgtggttgacgactggtattgtgctccgttagaggggccgcgcggcgcgacggcggaacaacttctggaacatctggggaaagggaatgtctatgatagcgtcgcgcaggcatggcaggccgctatcgacgcggcgcagccagaagataccgtgctggtgtgcggatcgttccacaccgtcgcacatgttatggaagtgatagacgcggggagaatcggtggcgagtaagtttcagaatcgtttagtcggcacgattgtgttagtcgcgctgggggttattgtgcttcccggtctgctggacggacagaaaaagcattatcaggatgaatttgctgcgattccactggtaccgaagcctggcgaccgtgatgagccggatatgatgcctgccgcaacgcaggcgctgccgacacagccgccggaaggggcggctgaagaggtgcgggcgggagatgcggcagcgccgtcgctggacccgtcgcgcatggcgtctaacaatgtcgagcttgatccgataccggtggagacgcctaaaccgaagccggttgaaaagccgaagccgcagcctaaaccgcaacagccggttgtcgccgtttccacgccgacgcccgcgccgcaaccggctaccgacgataaacctgcgccgaccggcaaagcctatgtcgtacagttgggcgcgctgaaaaacgcggataaagtcaacgagatagtcggcaagcttcgttccgccgggttccgggtttatacttccccctcaacgccggtacagggtaaaataacccgtattctcgtcgggccggatgcgtcgaaagataagatgaaaggatcgcttggcgagctcaagcagatttccgggttaagcggcgtggtgatgggatatagcccgaactaaggcgcgttttgcctgagcgcgcagcgttaaggcctatggtgttcatctggtaatagccgaagttctgtaggctggataaggcgtttacgccgccatccggcagaaggaataaaccgggtatcctgcgcttatcaggccgatggcagctcttctggtcgtgcccgaagagataaaaagtgtgatggcgttgaatattttttcagcgccatttttatttacgcgtgggaaggaaatccctacgcaaacgttttctttttctgttagaatgcgccccgaacaggacgacagggcgtaaaatcgtgggacatctatggtctggattgattacgccattatcgcggtgattgctttttcctgtttggttagcctgatccgcggctttgttcgtgaagcgttatcgctggtgacgtggggttgtgctttctttgtcgccagtcactactacacttacctgtctgtctggtttacgggctttgaagacgaactggttcgtaatgggattgctatcgcggtactgtttatcgcgacgcttatcgtcggcgctatcgtgaattttgtgataggtcagctagtagaaaagaccggcctgtcgggaactgaccgggtgttggggatctgtttcggcgcactgcgaggcgcgctgattgtcgccgccattctgttcttccttgatacctttaccggcttgtcgaaaagcgaagactggagcaaatcgcagctcatcccgcagttcagcttcatcatcagatggttctttgactatctgcaaagctcgtcgagtttcttgcccaggacgtaacaggttctgagatgtggcttaacgaggaaaatgacgtatgtgcggtattgtcggtatctccggtgttatgccggtcaaccagtcgatttatgacgcgttaacagtgctccagcatcgtggtcaggatgctgccggtatcatcaccattgatgcgaataactgcttccgcttgcgtaaggcaaacgggctggtgaacgatatttttgaagctcgccacatgcagcgtttgcagggcaacatggggatcggccatgtgcgctaccctaccgcaggcagctccagcgcttcggaagcgcaacctttttacgttaactcgccgtatggcatcacgttggcccataatggcaacctgactaatgcgcacgagctacgtaaaaagctgtttgaagaaaagcgccgtcatatcaacaccacctccgattccgaaatcctgctcaatattttcgccagcgagctcgacagcttccgtcactatccgctggaagccgacaatatttttgccgcgattgccgcgactaaccgtcaaatccgcggcgcctatgcctgcgtagcgatgattatcggccacggcatggtggcttttcgcgatccgcacggcattcgcccgttagtgctgggcaagcgtgacgttggcgatggtcgtacggagtatatggtcgcttctgaaagcgtggcgctggatacgctgggctttgaattcctgcgcgatgttgcgccaggcgaagctatctatattaccgaaaaggggcaactgttcacgcgccagtgcgcggataatccggtcagtaacccctgtctgttcgagtacgtttattttgctcgcccggactcctttatcgacaaaatctccgtctacagcgctcgtgtgaatatgggcaccaaacttggcgaaaaaatcgctcgtgaatgggaagatctggacatcgacgtcgtgatccctatcccggaaacctcctgcgatatcgccctggaaattgcccgtattctcggcaagccgtaccgccagggatttgtcaaaaatcgttacgtgggacgtacctttatcatgccgggccaacagctacgccgtaaatccgtgcgccgtaagctcaatgctaatcgcgcggaattccgcgataagaacgtcctgctggtggatgattccatcgtgcgtggcaccacatcagagcagatcatcgagatggcccgggaagctggcgcgaagaaggtttatctggcgtccgccgcgccggaaattcgtttccccaacgtctatggcattgatatgccgaccgccaatgagctgatcgcgcatggtcgcgaggtggatgagattcggcagatcatcggcgcagacgggcttatcttccaggatctgaacgatctgatcgaagccgtacgcgcagaaaacccggatatccagcagtttgaatgttcggtatttaacggggtatatgtcaccaaagacgtagaccagcaatacctcgacttcctggattcattacgtaatgacgacgccaaagcggtgctgttccagaacgaaatggaaaacttggaaatgcataacgaaggctaatggctttgccagcggcgcgatgccgctggccgatgtcaattacgcaccacgccgaagcgaatagcgtatttttgtactttgtactgtaacgtggtgcgggatacgttaaggctacgggccgcggcggcaatgttcccctgatgcgtatccagcgcggtttctattaaatgcctttcgtagttggcaacccgtacctccagcgacccttcatactgcggatcgggtgacgagggaaggggattctccggcgcggtttccggtacgcctaaatttaactcgtcctgttcaaaaatgatgtgtttcagcagcccgtctttttcctgcatgatcatgctgcgtacaatcgcgttttccagcatcctgacattacccggccaggcgtgattgagcagatcagcacgcgccgtctcgcttaatccgtgaatgtcctgcggcacgtcattacggtatttatcaataaaataattcgccagtaaggggatatcttccgggcgggcgcgcaacggcggtaacgtcaacattccgacgctcaaccgataaaaaagatctgcccgcaggcgttcttgttgaattaatttgacgggcgcttcgttcatggcggcaacgatcctgacatcagagtggagttgctgttgtccgccgagccgccagaaggttttatcctgcaagaatcgcagcagcttactttgcatttctatcggcatggcgttcagctcatcaagaaagagcgttcccccgtttgccagttccagatagccctggctattttccgcgccggtataggcgccgcgcacggtgccgaaaagcgtactttcgataagcgtaggcggtagagcgccgcagttcagggcgataaatggcttattcgcccgcttgctgcattgatgtatcaggcgggaaaatagctccttacccgttcccgtctccccgacaatcgtcaccggaatattactggcggccagccgtttggctttggcgatattactgagcatttccggattttcggtaataatggcatggtgcttctcatggtgatcggcatacagcagttggttcagttctaccacctgctcctggagccgcctgacgccggacatattcctgccgatttcgataacgccgaccatgccgccatcgcttgcatagagcgacgcggtggtgtgctgatagtcaacggcctggcctcgcgcattgtaataaatttgataatggccaatgtattccacgcctttttttaacgatgaaagcatcgtactttgggtttctttcatgcccggatagacatccagcatatgttttcccattgcccgttcaatgctgtagccgtccagatccgcgctttcctgattgtagtaaacgtattcaccacgctcattaatgacggccaacggctgatgaatcaaatcgaaaaagcgggaaaacatcctgagcgccgaggccagttcctgattggtggatgccatacatgcattcctcatatctattgttcatgttgccattataaaaatgacgaattttcgtcgttatgatgaatagcaaacttaatgacgaaaatgagaaacagcttatttttataaataattgattattttgataaaaaatagtggcatgccttttgctttatccctgtaaagaatgcggatttttaccataaacattaagcagagggcgttatgactgactcgattatgcagaattacaaccagctacgtgagcaggtaatcaacggcgatcgccgtttccagcacaaagacggtcatttgtgttttgaaggggtcgatctggacgctctggcgcgccagtaccccacgccgttctatgtgttttctgagccggagattattcgtaacattcatgaaatccagcaggcatttgcggcgcataaaaataccaaaaccttctttgcgtcaaaaacctgctcggtcatgggagtgttgaaagccattcgtgacgccggaatttgcgcggaggcaaactcacaatatgaggttcgcaagtgcctggagataggctttcgcggcgatcagatcgtcttcaacggcgtggtgaaaaagcctgccgatctggaatatgccatcgccaacgatctgtatcttattaatgttgatagcctgtatgagctggaacatattgatgccatctctcgcaagctgaagaaagtcgccaatgtttgcgtccgcgtagagccgaatgttccctcggcgacgcatgcggaactggttaccgctttccatgcgaagtcgggtctcgacctggaacaggcggaagaaacctgccgccgcattctggcgatgccttatgtgcatttacgcggcttgcatatgcatgtgggcgatcaggtgccggagtcagagcctttcgcaaaagcgactaaagtgctggtggatgaatcccgtcgcctggaagaggtgctcggtattaaatttgatttgatcaacgtgggcggcggaattccggttccctataaatatgacgacgagaatggcgacccgttaaaagataatatgtatgccggtattaccgcccaggattttgccgatgcggtcattcgcgaagtgcataaatggcgtaccgatgtggaaatatgtattgaaccgggacgtaaagtgaccgggtcggcggcggttttactgacggaagtctcctgcgaaaaacgtaaaacaaattacgatcttaacggcaatgtggaatgccacgttgaatggaaatttgtcgatgctggttacagcgtactctctgatagccagcattttgactggttcttttatgtctataacgcctctcgcatgacggcagcgcacgacgcctggataaaattagccgggccgctgtgtgatggcggggattatttccacatgggagtgaaaggcgaagagtttttactgccgaaggagactcatgttggcgatattgtcgcgtttcttgatgccggggcatacaccattgaaagtcaaaccgtttataacaaccgtccgcgcacgggggtggtgatgatcgataaaaatggtgagacgcgtctgattcgtcgggaagacagttacgaagatatggtcaagtacgacatttattaatactgttttgggcttcagtttcatgctgaagcccgtcgtcagatgataagaagagggcagtgatgcctgaatgcataacaggagatggccatgagtaacacgaattctggcttacttggcatcaaagacattgtctttatgaatgtcatcgctattctgagtttgcggcaaatccctaacgtggcgccttacggggcatcggccatgttgctatgggtgatagccgcattctgcttgttttttcctttagcgatggtatgcggcgagctgtcaaccggctggccgaaagatggcgggatatttgtctggattaaagaggcatttggtaaacgtattgcatggattgtcgtggtttgttttctcttttcctgcgtactgtttttcccattaatgctgcaattcggctttaccgcgttgggctatatgatcggcggcggcctggcggaaaataaagcgtttatcggtattggttccgcggtaattttctggctattaacgctgatgaatatccgcgggatggaatggacaaaaattattaatagcatcagcgcctggtgcgacgtatttattccctccgccatcctcattttgctggcggtggtatggctatgtaccggacaccagatgcagacggactacactacagcgaaaaactggattccggatctcggacactgggatacgatcgttttcttatccagcatgatgtttgcgtttgccggactggaggtcgccccgatgattgccgggcgtacccgtaatccacagcgtgattttccgcgagcgatggccgtctctgccgccgttatcgttgggatctatatggtcggcacctgggcgctaaatacgcttttacccgccgggaaaaccgacatcgtggcaggcgtcatgcaggctatgcatgctgctgcggacacgctgcatatgccgtggttaattcctgttatggccatctgtatgttttttggcgctctcgggcagattaactcctggctggtggggccgatttatatgctccaggaagcctcgcgtgaagataatctgctgggggaccgaatcggcaaattacatccggtgtggaaaacgcccgcctttgccttgactatacaggcgattattgtcacggtcctgtgtttttcgacttttatttcgccaagcgttgcggcggcttactggatgttaacggcgctaacgaccatcacctattttattccttatctggtgatgttcccggcgttctggcgtttacgtaagactcagccagatacgccaagaagttttaaaattccgggcaaggttttaccggctattttacccgcgctgggctttctttctatcgcctttgccgttgcgctgttatttattccgccttctcaaattgatatgggcggatatttccagtacgccgggaaaattattggcggagccgtgctggcggttgtcgtcgcggagtacatttaccatcgggcgcagaaacgtaatgcccgtttaagcatggcgggaggaaaataaaatgtatatgccagttctggaaataaatctacgcaagctggaagaaaacgcacgcacggaaaaagctctgctggcaagcagcggtattgacgtgatggctgtcaataaagtttttgacggctgcgtggaaaccgcgcaggcggtgttaaacggcggaattaccgttattgctgaatcacgaacctataatttgaaaaaaatacgcgagacaggatgtacgacctgcctgttacgcagcccgtgtctgagtgaaatcgaagatgtggtgcgctacgcggatattagtttaaatagcgagccggtggtattacgggcattatcgcaagaagcccaacgccaggggaaaacgcatcaggtattactgatggtgaatatgggcgatttacgcgagggtatctggtttggtgaatatcaacgcattcttgagaccgtgactctgattactggtctgcccggtctggaattatatggactgggcaccaactttaattgttacggcaccgtgttgccaacggtaaaaaatggcgaggattttctggcgctggccgcccggctggaagctgacagcggtattcctgtccggcggctttctgcgggaaactgcaccagctatcacctgctggataaaggtatctggccgcagggactgaatcatctgcgcatcggcggactgcatgaattcggcattgaatatgtggacatgaaatacctgaatgaatttcaccactccgcaaaaccggtcgataaagcctgttccgatatgtatatcctggaagcggaaatcatcgaactgaacagtaaaccgaccgtcccggtcggggagctgggcgtcgatgcctttttgcaaagtaaaacctttgtcgatcgtggcatacgccgacgcgcattgctggcgtttggtcgtcaggatgtgccgtcggataactgtgtgccatgcgacgacgctatcactatcttagggcaaaccagcgatcatacgctggtggatattgaagattgtcgtcagtcgctaaaagtaggcgatgtggttcgctttgagctggattatacgggcctgttaatggcctgccagaccaaaggcgtcgcctggaggtttacgcgttaacgcataaccgccgcggctatgtcgcggcggcatctttgacctcacgaaagacagggagtaacgatggataccctgcaacaatctccgccagcagagcctgaaggcggtctgcggcgtaacctgaagaagcggcacctgctgatgatgtcgctgggcggcacgattggcaccggcttatttatcggcattgccgaaccgttaagcagcgtcgggccggcgggaaccttactggcctatctgtttgccggaaccattatgctggcgacgatgatgtgtcttggcgaattatcatgcgcctttcctcactccggttcatttcaacattacgcgctgatgtttatgccgtcaccttgctggagctataccattggctggctttactggtttagctgggtcttttccctggcagccgacctcactgccgcagggtttattgctcaccagtttttccccgcggttccggtatatatgttctgcctggcgattctgctcatcctgacggctatcaatctcacctccgcaaaaagttttggcgaatgcgaatactggctttcggccattaaggtcttcgcgatcgtgctgtttatctgcgcgggcggggtcatgatctactcgctaatgggccatagtgactggcacccgacgttaaaaacagacggaatgtggtttccccacggttgggagcaaattgtggtctgtatgacgatcgtgatttactccttccagggggtggaactggtcggaaatgcggcaggggagaccgaatcgccgcacattattttaccgaaggtgatcctggggatcggtctcagaatcattttgttttacggcctggcgattgcggtgctggcgctggtctatccgcatgaactgacgccaaatggacaaagtccctttgtatgggtattctcccacgcgggcattccgggggcggatacgctgatgacgctggtgatcttttccgccgcggtttctgccgctaactcggccatttacgccagttcgcgtatgctgtggtctatggcgggcgatcgctttgcgccagcctgctttggtaaaacgaacggcggcggcgtgccggtgtatgctattttaatcacgaccttgctggcgttggtgtcgttgctgacccgctatattcccgcacagcaattttatttatatctgatcgccagtaccgggcaggtgggttgcctggcatggataaccatcggatggtgccagtatcgcttccgacaatcggtgcgtaatggcacgtacgccagcgatttgctacgctatcgatcgccgctttttccctggacggcccgatttgtcattatcaccaattttgccattatggtcggcacctagtttagtgagcagggagtagtgataatgttggttgagctggcttttatgatagggattcttttgtcatggtatctcttcagacccactttgagccggttacgtaacacagtgggatgaacggcgctcgtaaacggtaagaggacatgaaacgactcattgtaggtattagcggcgccagcggagcgatttatggcgtgcgcttattacaaattttgcgcgatgtcgatagcgtggaaacgcatctgatgatgagccaggcggcccggcaaacgctggcgctggagacccatttttcgctgcgcgaggtgcaggcgctggccgatgtgacgcacgatgcgcgcgacattgccgccagcatttcctccggctcttacccgacggcaggaatggttatcctgccctgttcgattaaaacgctgtcggggattgtccacagttatactgacggactgcttacccgcgcggcggatgtgatattaaaagagcggcgacctctggtgctgtgtgtgcgcgaaacgccgctgcatatcgggcatttgcgtttaatgacccaggccgctgagataggcgcggtgattatgccgccggttccggctttttatcaccttcctcagacgttagatgatgttataaatcaaacggttaaccgagtgttggatcaatttgacatcccccttccgcacgacctttttgttcgctggcagggcgcatagcgttgtctgtttagcgtgcattattgtccctgttgccctgtttcagggcaattttgtaaccgcgatcatatcctcaacatttaattcgttaaaagccgccgaaacgctgcggttcaaccgtcatacctgctatcttcaacatcaggacaatattgcaacgttttattaacaaatttaacgtcgaatcgttttgctgacgtgaaaatggcataagacctgcatgaaaaagtctgcaaacacacaacgccacgtaaaacataaaaaaatgacgccacttgaggggtatgtatgaagaagaccgttctcgctttgtctttgctgataggtctgggcgcgacggcggccagttacgccgcgctcccgcaaacggttcgtattggaacagataccacctacgcgcctttctcatcgaaagatgccaaaggcgactttattggctttgatatcgatctcggtaatgaaatgtgtaagcgtatgcaggtgaaatgtacctgggtcgccagcgactttgatgcgcttattccctcactaaaagcgaaaaaaatcgatgccattatttcatcgctctctattaccgataaacgccagcaagaaattgcgttttccgacaaactttacgcggcggattcacgcctgattgcggcaaaagggtctcccattcagccgacgctggaatcgctgaaaggcaagcatgtcggcgtgctgcaagggtccacgcaagaggcttacgccaatgataactggcgcactaaaggtgtggatgtggtggcttatgccaaccaggatcttatctattccgatttaaccgccggtcgtctggatgccgcattgcaggatgaagtcgccgccagcaaaggtttcctgaagcagccagcgggcaaagagtatgcgtttgccggtccttccgtgaaggataaaaaatattttggcgacgggacgggggttgggctgcgcaaagacgataccgagctaaaagccgcgtttgataaagcgctgaccgaactgcgccaggacggaacttacgacaaaatggccaaaaagtacttcgattttaatgtctacggcgattgagggaaggggataacgcgccgcgctggggaactatcacggtgcaaaatagatgttttgcacctttttggtgcataagccgttgcggaacaggcgcataaatgcatacttaatcgatttttatgcaaaataaaccggctgacaaggtagaatgctttgccttgtcggcctgattaatggcacgatagtcgcatcggatctgtaaagatctcctggaaagacagtctgttgaggatagttatgaaaaaactggcgttatccctttctctggtgctggcattttccagcgctaccgcagcatttgccgctattccacaaaagattcgcatcggtaccgatcctacatacgcaccgtttgaatccaaaaatgcacaaggtgaattggtcggctttgatatcgatctggccaaagaactgtgcaaccgtatcaacacacagtgtacgttcgtggaaaacccgctggatgcgctgattccgtctttaaaagcgaagaaaattgatgccatcatgtcctcgctgtccatcactgaaaagcgccagcaggaaatcgcgtttaccgacaagctttacgccgctgattcccgtctggtggtggcgaagaactctgatattcagccgaccgtcgcgtcgctgaaaggcaagcgcgtcggcgtgctacaggggacgacgcaggagaccttcggcaatgagcactgggcgccgaaagggattgagatcgtctcttaccaggggcaggacaacatttattccgacctgacggctggccgtattgatgcggcgttccaggacgaggtcgcggccagcgaaggtttccttaaacagcccatcggaaaagactataaattcggcggcccggcggtgaaagatgagaagttattcggcgtaggaaccggtatggggctgcgcaaagaggataacgagctgcgcgaagcgctgaacaaagcctttgctgaaatgcgtgctgacggtacttacgaaaagttggcgaaaaagtactttgattttgatgtttatggcggttaatcaccgtcggtgcagataaagcccaaagaatattgactgtctgcattgcctgagggcgctgtgcgcgtcaggcctacggggagcatcgtaggccgggcaaggcacagccgccatccggcgtgatgtgaggcaaaaatgcaaaagaggcttcttacttcaccacacacaacaggacaggctgcatgttgtacgggttttcaggcgtaattttacagggcgcgatcgtcacgctggaactggcgctcagttccgtggtgctggccgtgcttatcggtctcgtcggcgcgggggcgaagctttcgcaaaaccgggtaacggggcttatttttgaagggtacaccaccctgattcgcggggtgccggatctggtattaatgctgctgatattttacggattgcaaatcgcgcttaacgtggtgaccgattcgctgggtatcgaccagatagatattgatccgatggtggccggtattatcacccttggtttcatctacggcgcctattttaccgaaacctttcgcggcgcgtttatggcggtaccgaaaggccatatcgaggcggcgacggcctttggttttacccacgggcaaaccttccggcggattatgttcccggcgatgatgcgttacgccctgccggggatcggcaataactggcaggtgatactcaaagcgacagcgctggtgtcgctgctgggcctggaagatgtcgtcaaagccacgcagcttgccggtaaaagcacctgggagcctttctattttgccgtggtctgtggacttatctacctggtatttaccaccgtttccaatggtgtgctgctcttacttgagcgtcgctattccgtaggcgtgaagagggccgatttgtgattgagatcattcaggagtactggaaatccctgctgtggacggatggctatcgttttacaggcgtggcgattacgctgtggttgttaatttcatcggtggtgatgggcggtcttctggcggtgattctggcggtgggtcgcgtttccagtaataaattcatccgttttcccatctggctgtttacgtatatttttcgcggcacgccgctgtacgtacagctactggtgttctattcggggatgtatacgctggagatagtcaaaggcaccgatcttcttaacgcgtttttccgcagcggactgaactgtaccgtactggcgctgacgctgaatacctgcgcatacactacggagattttcgccggagcgattcgttcggtaccgcacggtgaaattgaagcggcaagagcgtatggcttctcgtcatttaaaatgtatcgctgcattattttgccgtcggcattacgcatcgccttgcctgcctacagcaacgaagtgattttaatgctgcactctacggcgctggcgtttaccgcgacggtgccggatttgttgaaaatcgcccgcgatattaactcagcgacttaccagccgtttaccgcgtttggcattgccgccgtgttgtatttactcatttcgtatgtcctgataagcctgttccgccgggcggaaagacgctggttgcagcacgtgtcctctaaataattcgagtaacatgatgtcagaaaataaattacacgttatcgatttgcacaaacgctacggcggtcatgaagtgctgaaaggggtatcgctgcaggcccgcgccggagatgtgattagcattatcggctcgtccggttccggtaaaagcacttttttgcgctgcattaacttcctcgaaaaatcgagcgaaggcgcgattatcgtgaacggtcagaacattaatctggtgcgcgacaaagacgggcagctcaaagtggcggataaaaatcagctacgcttgttgcgtacccgcctgacgatggtgtttcagcactttaacctctggaaccacatgacggtgctggaaaatgtgatggaagcgccgattcaggtactgggattaagcaagcacgacgcgcgcgagcgggcgttgaaatatctggcgaaggtggggattgatgagcgcgctcagggcaaatatcccgtccatctctccggcggccaacagcagcgcgtttctattgcgcgcgcgctggcgatggaacctgacgttttactgttcgatgaacccacatcggcgctcgatcctgaactggtcggcgaagtgttgcgcatcatgcaacaactggcggaagaaggcaaaacgatggtggtggtcacgcatgaaatgggcttcgcccgccatgtctcttcgcacgtgatttttctgcatcaggggaaaattgaagaagagggcaatccggagcaggtgttcggcaatccgcaaagcccgcgtttacagcaattcctgaaaggctcgctgaaataaaagaagcccggcggcgcatcgcttaccgggcaggatacggcgctttgggaattagcgaatcacatccgccagcgcctcttctaaatcataccagcgaaatgcgaatccggcggcttcaagccgttttggcagcgcccgctgtccgcccagtaccagcactgacgactctcccatcaataagcgaattgccgtcgccggaatgcgaataatcgccgggcggcgcagcgcgcgacccagcgcatgagcaaactgctcattatggacgggatacggcgagaccatattgaagggaccgcgaagatcgttatccagcagccacaggatgccgttgaccatatcgtcaatgtgaatccaggccagatattgccgaccattacccaccggaccgccgagtccgaggcgaaacggcggaaccattttccccagaatcccgccttgcggcgccaggacaacgccggtacgcagcaggcagacgcgggtctggtcgctctgcgcacgacagacaatctgttcccagcgggcgcaaagtttatgcgtaaattcgttgtgcggcggctcatcttcagtgacgacaacgtcgcccagatcgccgtaatagcccgtggcggagccggatatcaacaccgagggcggcgtagcgctggcatgaattaaatccaccaacttttgcgtgatagcccagcggctttggcacaaccgttctttttgttgcgacgtccagcgcttgtcggcaatcggttcgcccgccagattgatgatggcatcaatctcattgaggtgctcacgttccgccagccctttccataatgtcactctggaatcgagaatctgacgcgcgttatcgggattgcgcgtaacgaccgtcacctggtgccccagtattaacagccggggaatgagatgacgccctatcaggcccgtaccgccggtaatcagaatctgcatatgacctccagagtagggaggatttcctcttccctaatgtcaggtttttaatacgaataagggtgccggacgcaggttttccgtgtatacacctctacatcatacatgatgtatgctaccgcgttacgctttcgtactgttacagtgcagttgcgcttgtaacagtgcgcgcgctgtcgcaggacgcgtgcgaatgcgttcaaaccagttatacaccgccgggtaagtatcaagatcgattcgctgacgctgatgtgcgttaacccacggccaactggcgatatccgcaatactgtagtggtcgccgcccagccacggggaggtttccaggcgtttattcaggacgttgtataagcgttgcgtttcaacctgatagcgttcaatcgcataggggatggcctgtggcgcaaagtggttaaagtgatgattctggcccagcatcggccctaacccgccgacctgccagaacagccattgcagcgtggtatggcgttcacgcagctccccgctaagcagtttgccgcttttttccgctaggtagagaagaatttcgccggattcaaaaagactaagcggttgaccgccgtctgccggggcgtgatcgacgatggcaggaattttattattgggagagatagccaaaaaatcagggcgaaactgattgcccttgctgatatctacttttagcaaacgatacgccagctccgcctcttccagaaacagcattattttatgcccgttgggcgtgggggcgtagtaaaggtcaatcattttggctcctgcatgtgcgtaaagagtctgggctgaattaagtatagaaagcctcctgatgtgtgtgagttttcatcaggtgacagcaggcgaaagacgctatattttgggaagaaacctaatacgccctcaagaggacattatgagtaagcctgttattgtgctgtggtcggatgcgaactttttctctccctacgtcttgtccgcctgggtggcattacaagaaaaagggctttcctttactctgaaaacccgcgatctggaccagggagaacatctgcaacctggctggcggggatatgcgctgacgcagcgcgtcccggtgcttgaggccgacaattttgagctgagcgagtcgtccgctattgcggaatacctggaggagcgtttcgcgccgccgcagtgggagcgtatctacccgcacgatttacaaaaacgcgcccgcgcgcgacagattcaggcgtggctacgcagcgatttactgccgcttcgcgaagaacggcctaccgacgtggtgtttgccggggcgaaaaaagcgccgctaagcgaggctggaaaagccagtgcggcaaaactgtttgcgacggctgaagcgctattggggcaggggacgcaaaatttatttggtgaatggtgcattgccgataccgatctggcattgatgatcaatcgtctggtgctgcatggcgatgacgtgccggcgtcgctggcggcgtatgcgacatttcagtggcagcgtgcttccgtacagcgttttattgcgctttcctcgaagcgttcaggctgaaaatctattcatattccagtatcataacgccgtttttcacaatgaggagtgagcgatgaaactgatgttcgcatcggacattcatggttctttacccgccacggaacgcgtgcttgagcggttcgcgcaaagcggcgcgcgttggctggtgatattaggcgatgtccttaaccacgggccgcgcaatgcgctgcctgaaggctatgcgcccgcccaggttgccgaacgcctgaacgcggtggcgacgcaaatcattgccgtgcgcggcaactgcgatagcgaagtggatcagatgctgctgcatttcccgataactgcaccgtggcagcaaatattgacgcaagagaggcggctatttttaacgcatgggcacctcttcgggccgacgaatctgcccgctctgcatactggcgatgtgttggtctatggtcatacgcatctgccggtggcgcaacagcaggaaggactgtatcactttaatcctgggtcagtgagcatcccgaaaggcgggtatgcagcaagctacggtattctggatgataatgtgttgagcgtaatcgcactcaatgatcaaagtatcattgcgcaggttgcaattaactcgtaatttacctcacaaacgtaaatgcgccgtaagagcgccagaaataagaaggtttcctgatggtggaacagcgtcgtttggcaagtacggaatgggtggatattgtgaatgaagacaatgaagtcattgcacagtccagccgggaacagatgcgtgcgcaacgcttacggcatcgtgcgacgtatatcgtcgttcatgatgatatgggtaaaattctggtgcagcgtcgtaccgaaacaaaagattttttgcccggtatgttagatgctaccgcaggcgacgtggtccaggctgatgagcagctactggaatctgcccgccgcgaagcggaagaagagttgggtattgcaggcgtgccgtttgccgaacacggtctgttttactttgaagaccaacattgccgggtttggggcgcgctgtttagctgcgtttcccacgggcctttcgcgcttcaggaagatgaagtcagcgaagtgtgttggctgactccggaggagatcaccgcgcgctgtgatgaatttacgccggactcgctcaaagcgctggcgctgtggatgacccgcaacgccaaaaacgaagccgcgcttcaggagaaaccggaagagacggaataagcgttttagcagctttcccgcatacataaactggaggcgatagattttcgatcgctccagtttccctgatttaacctttccaacagcgcccgtccggcttcactgccaatcttacggtgcggtacggccatggtggttaacggcggctggcagacccggctgacatcgctatcgccaaacccgaccaccgctaaatcgtccggaactttgatccgccgtcgttggcactcgtataacgcgccgcaggccagctcatccgatacgcataccagcgcgtccagctccggccatgctagtaaaaactccggcagttgcgacgcgccggtagaaaaattgggcggcaaggcggcattaatcacccggtttggcgacatatggtggcgaagcatcgctttgtaccagccgtgcagatgttgctgaaaaatccactgctcctgattggcgcatagcagcccgatattctggtaaccgcgctgaatcagcatttccgtcagctcatacattgctgcaacgttatcaataccgatattcatatcaataggatcgctgcgaatcgcgcccatctccatcaccggaatagaggcatttttcagccactggcgcacggtagtgctatgttcgacgctaagcagaatcgccgcggcaatgttggaagccagcagcgtttcgagcagcttctcctcttgttccacgcgatgctgcgattccgccagcattatctggtagcctgcgggctgtaaaatttgttgcagcccggcgaacatttcagaacaccccgcttccgcaaggttcggtacgaccatcgcgatggtgtgcgaggaggcagacgccagcgcgctggcggcgagattaggcatatagcccagctcatgcactgccgcttcgattttttcccggagtttatcagagacctgttccggcgtgcgtaaggctcgtgatacggtcatcgtgcctacaccggcaagttgggctacatcggcgatagtcactttaccggtactgcgccgtttacggggtatcgacatacaaattcctgcgtcattacaacatgttgagatgcttttttattgtcgttctttgcttcgcatgactggcagtatacgccttaaatccgcttttttgctgtgatttcacaccatgattttaatttgatagcgctatcacaattctgagtaatagtcgctggtagcgctatctttgtgataacgatcgcagctaatatcgaatggcttgaataaagtttgttcataatttcatacaccgtgggggcgaataacatgctgggaacctggttatctgacgcaaccatcacgctacgggagagcgtggaaacgtggccgcaagcgctggaaatttgcggcaaacccctgctggacgcaggtgttatcgcaccggaatacattacggcgattgttcagcagcaccaaaagcttgggccgtattatgtattagcgccagggttagcgatgccgcatgcgaggccggaagagggggcgaaagggttaggtttatcgttactgaaactacagcgcggcgtttcatttggcgcagacgaattcgatccggttgacatcattattatgctggcggcgcctgataagcacagtcatatcgaaatgatatcggctctggcggaattattttccagtgatgtagatatggaaaaattacatcaggcaaaaaacctggaggacattaaaacgattattgaccgtttctgattttattccattttcttgcggtaaataacattgcgcccgtgcgtgatgcagaccaactctacttttaaaaggtgacaataatgaaaatcatggcaatttgcggttccggcctgggtagtagttttatggtagaaatgaacattaaaaaagtattaaagaaactcaatattgacgctgaagtggaacactccgatctctcatcggccacacccggggctgccgatctttttgtaatggccaaagatatcgcggccagcgccagcgtaccggaaagccaactggtggtgatcaataacatcatcgacatcaacgaactggaaacgcagctgcgcgcatggttcgctaaacaataattattgctggcgaggtggatatgtttatccttgaaacgctgaattttgttgttgatattttaaaagtgccatcggtgcttgtagggttaattgcgctgattggtctggtggcgcagaaaaaagcgttttccgatgtggtaaaaggcacgattaaaaccattttaggttttattgtgcttggcggtggcgcaaccgtactggtgggttcattaaacccgctagggggtatgtttgaacacgcttttaatattcagggtattattcctaataatgaagcgatagtctcaatcgcgctggaaaaatatggcgcgtccacggcgttaattatggcatttggtatggtggccaatattgtcgtggcgcgctttacgcgtcttaaatatatctttttgaccggacatcacaccttttacatggcctgtatgattggcgtaatcctgaccgtggcggggtttgagggcgtagggctggtcttcaccggatcgctaatcctggggctggtgatggccttcttcccggcgttggcccaacgttatatgaggcggattaccggtaccgatgacattgcgtttggtcacttcggtaccctgggatatgtgctttccggctggattggcagcctgtgtggtaaaggctcccgctccacggaagagatgaacctgccgaaaaacctcagttttttacgcgacagttctatctcgatttcgctgaccatgatgattatctatctgatcatggcagtcagcgcagggcgtgagtatgtcgaagcgacgtttagcggcgggcaaaactatctggtgtacgccattatcatggcaatcaccttcgccgccggcgtattcatcattctgcaaggcgtccgtctgattctggcggaaattgttccggcctttaccggcttttcagaaaaactggtgccaaacgcgcgtccggcgctggactgcccggtggtgtatccctatgcccctaacgcggtactgattggcttcctgttcagttttctcggcgggctggtggggctgttcctgcttggacagatgaagcttgtgttaatcctgcctggcgttgtgccgcacttctttaccggcgcgaccgcaggcgtctttggcaatgccaccggcggtcgccgcggggcgatgatcggcgcatttgctaatggtctattaatcactttcctgccagtgctgttactgccggttctcggcgcgatcggcttcgccaataccacgttctcggatgctgactttggcgtaatcggtattttgctgggcaacctggcgcgttatctgtcgccgatggctatcacggggctggtggtggcgctattcgcgctactggtggcgtacaacgtgttggccaaaagcaaaaaagcgactgccgaagtgcaggaaaatagcggagcgaaagaatgaacgtaaccgaaatcacccaactggcgcgcgacattcgcgtcgccacgctcaaatccttaaaccatcttggctttggtcactatggcggcagcatgtcggtagtggagactctggcggttctgtacggcgcggtgatgaaaatcgaccctgccgacccggactggccggagcgcgattacttcgtactgtcgaaaggccatgcgggccccgcgttgtacagtaccctggcgattaaaggctatttcccgcgcgaagagctgaatacgcttaaccagaacggcacccgtcttcccagccatccggatcggctaaaaacgcacggcgtggacgccacgaccggctcactgggacaaggcatctctattgcgggcggaatggcgttgtcgtataaactggcgcggcgacccaaccgggtattttgcattgtcggcgatggggagctgaatgaagggcagtgctgggaggcgtttcagtttattgcccaccaccgcctgaataatctgaccgttttcattgactggaacaaacaacagcttgacggcgagctggaggagattatcaatccattcgatctggaagggaaattccgcgcgtttggtttcgatgtcgtcaccgtcaaaggcgatgatatcgccggactactggcggtggttcagcctgtgccgcccgctgatgcccggccacgggttgtgatccttgacagcattaaagggcagggggtgccatgcctggagcagttaacgaattctcaccacttacgcctgacggatggcatgaagcagacgctcaatgaggccattcatcaactggaggtcatgcatgattaagcttgcgcccgcagggcttaaagacgatatcgaaatgcgcaaagtttatgccggttttgtcgccgggcagattgaggccggaagcccaattattgcgcttgaggctgatttaatgagctcgatggcgatggacagcgtggcgcgtgactacccgcagcatgtcattaactgcggtattatggaggcgaatgtgattggcacggcggcgggactggcgctgaccggtcgcaaaccgtttgtgcatacctttaccgcttttgccagccgtcgctgttttgatcagctctttatggcgctggattatcagcgtaacaacgtcaaagtgatcgcctccgatgccggagtgacggcgtgccataacggcggcactcatatgtcttttgaagatatggggattgttcgcgggctggcgcactctgtagtactggaggtgacggatgcggtgatgttcgcgaatattttacgccagctaatggacctggacggtttttactggctgcgtaccatccgtaagcaggcgacgagtatctatgcgccaggctctacctttaccattggcaagggcaacgtactgcgcgagggcgatgatattacacttatcgccaacggcattatggtggcggaggcgctggaggcggcgcgccaactggagcaggaaggcgtgagcgctgcggtcattgatatgttcaccttaaagcctatcgatcgcatgttggtgaaaaactacgcggaaaaaacgcggcgtatcgtcacgtgtgaaaaccacagtatccataatggactagggtcagcggtagcggaagtgctggtggaaaactgcccggtgccgatgcgccgtgttggcgtcaaagagcgttatgggcaggtaggaacgcaggatttcttacaacaagagtacggactcaccgccgcagcgattgtagaagccgcgaaatcactgctttaatcatggagatattgccggatggcgctgatgctcatccggcattttggatcaatgatatcccatcatctgcgcgccaatcacgaccacgctggacatgataaacagcagtcccagcagcgacgcccccactttaagccagttgcgaaaatcgacccggcacacgcccagcgtggccatcagcgaagctgatgtcggatagataatatggctgaagccatcgccaaactggaaggcaagaacagtcacctgacggttaacgtcgaccagatcgccgagcggcgccagtaatggcatggttaacgccgcctggcccgaaccggacgtgacaaagaaattaaataccgcctggaagagcagcataaaccaggcggcgatagcattattaagcccgctgatgccatgcgcgatactgttaagcaacgtattgagcacgctgggttccccggcttcgccgttgccgaccagcagcagaatgcctttggcaaaacccaccagcaaggcgggcgcgatcatcatcctcgccccttcggtgaatgaggacgccatcacgttgaccgtcataccgttgaggcggaagataacgccgatgaggccgatcaccacgcccatggtgaaaaactggctggcgatctccggaataaaccaggcgtggacaatcacgccccagacgacccaaatcattacgccggtcagaaccagcagtaccagccagtcgccgaaggtgaaagggcgctggacgacttcatcctgctgttcgcggaaatagcgatcggattcgtggacgcgggaaagcagcggattctttttcacgcgtgaggcgtagaccagcgtaaaaaccagcccaatcagcgtggcgacaatccagaccacaatacgcagcccggagccggaaagtaccggcacgccggcaatcccctgggcgacgactacgcaaaacgggttcatccacgaactggcaaagccaatttgggtggcgatataggtcaccaggacggtggtaatgctgtcatagcccagcctgaccatcagcggggctatgataattgcaaaggcgaccgcctcttcgcccatgccaaatacggcgccccctaacgaaaagaggacaaatagcaccggaataaacaggacttcgttgccccgcgtgtggcgaataagcgccagaatgccgttatccacggtgccggtacgcatcacgatgccgaatgcgccgccaatcaccaacataaacataatgatgccgacggcagtgccgaatttcgatccggatgttaacccttcaaacggaaaattcatcagccctggtctttcatcgccggtagtgaaaaattgtacgcgatgatactgcgcttctccggcctcattggtcacaatgcgaaaagagtgcgggtcgacgactttgcgggtttttgtctgaccatcgacctgatactgcacttcctggctatcaaacatcccaacggggacgacccaggtggcgatactggttaaaatggcgacaaaaaagatgatgaccagcgtatcgggcattgcccattttctggctgtttttgattctgtaacgacagacatgacggactatccctgttgcaaagcaaagaggccaagtatgagaagaagggaatagttattcattgatgcagcgcagttaagcaaaaaattccgctttgcagggtaaatagcagaatgccggatggcgatgctaacgcgtcttatccggcctacaacggtatctcacctgtaggccggacaaggcgttcacgccgccatccggcattagcttttactgttactgctgctgttgagaagcctggatcgccgtcagggcgatggtgtagacgatatcgtcaaccagcgcgccacgggacaggtcgttcaccggcttgcgcataccctgcagcatcggcccgatggagatcaggtcggcagaacgctgtaccgctttgtaggtggtgttaccggtgttcagatccgggaaaatgaacacggtagcgcgacccgcaaccggcgagttcggcgctttggatttcgctacgtcagccatgaccgcggcgtcgtactgcaacggaccgtcgatcatcaggtcaggacgtttttcctgcgccagacgcgtcgcttcacgtactttctctacgtcgctgcccgcgccagaggtgccggtggagtaggagagcattgccacacgcggttcgatgccgaaggcaatggcggaatccgcagactgaatcgcgatttctgccagctgctctgcagtcgggtctgggttgattgcgcagtcgccgtaaacgtaaacctgttccggcagtagcataaagaacacagaagagaccagggagctacccggcgccgttttaataagctgcagcggcggacggatggtgttggcggtggtatgaaccgcgccggaaaccaggccgtcgacttcgtcttgctccagcatcagcgtgccgagcaccacgttgtcttccagctgttcgcgggcaaccggttcggtcatgcctttgctcttacgcagctcaaccaggcgagcgacatagctttcacgcaccacttccggatcgacgatttcaatacctgcgcccagctctacgccctgagatgccgcgacgcggttgatttcatccgggttgcccagcagtacgcaagtggcgatgccgcgttcagcgcagattgccgccgctttgacggtacgcggttcgtcgccttccggcagcactacgcgtttaccggctttacgcgccagctcagtcagttggtagcggaacgccggcggagagagacgacggctacgctcggaagtggcggtcagcgactcgatccagtcagcgttaacgtagttcgcgacgtattcctgaactttctcgatgcgctcatggtcatcaaccggaacttccagattgaagctttgcaggctcagcgaagtctgccaggtgttggtgttcaccataaagaccggcagaccggtggcgaatgcgcgttcgcacagtttagaaatgcgcgcgtccatttcatagccgccggtcagcagcagggcgccgatttctacgccgttcatcgcggccaggcaagctgcgaccagtacgtccggacggtcagctgaggtcactaacaacgatcctgcgcggaaatgctccagcatatgcggaatactgcgcgcgcagaacgtaacggatttaacgcggcgggttttgatatcgccttcgttaatgatggtggcgttcaggtgacgcgccatatcgatagcgcgggtcgcaatcaggtcgaagctccacggcaccgcgcccagaaccggcagcgggctggattcctgcagtttagcaggatcgattttgatcacctgcgctttggaagagtcgtcaaaaatctctgacagatccgggcgagtacggccttgttcatcaaccggcgcattcagtttgttgatgataacgccggtgatgttggtgtttttcgcgccgccgaagctgctgcgcgtcagttcgatacgctcgttcagctgttctggcgtgtcggtaccctgagacatgacaaaaacgatttccgcattcagcgttttcgcgatttcatagttcagagactgagcgaactgatgtttacgggtcggaaccagaccttcaaccagcaccacttccgcgtctttggtattcgcatggtagtttgcgatgatctcttccatcagcacgtctttctggttgctggagagcagagattcaacgtggctcatcttcagcggttcagccgccggcagggtagagttcgcgcgaacgatagtggtggtctggtcaggcgcatcgccgccagcgcgaggctgggcgataggcttaaagacgctcagacgaacgcctttgcgttccatagcacggatgacgccgaggctgacgctggtcagaccgacgctggttccggtagggatcagcataataatacgggacacggtttatcctctttcgttaccgtcttttggggacgggttacaaaacagcaccgccagcgaggctggcggtgtgaaatcaggcagtcagacggctcgcgtcctgcgcgataaccagttcttcgttggttgggatcaccaccgccggacgggtaccttctttgttgatgaaaccagatttgccgaagcgggccgccaggttacgttcgtggtcgacttcaaagcccagtacgcccagtttgcccagagacagctcgcgaaccatcgcggcgttttcaccgataccgccggtgaacacgactgcatccagacgaccgtccatcagagcggtgtaagaaccgatgtatttcgccaggcggtggcagtaaacgtccatcgcacgttttgcgtcttctttggtggcgtagttgtcttcaacataacggcagtcgctggtcacttcagtcagacccagcagaccggactctttggtcagcattttgttgatctgatccacgctcatgcccagagtgtcgtgcaggtggaagataatcgcagggtcgatatcgccggaacgggtacccatgaccaggccttccagcggggtcagacccatagaggtatccacgcatttaccgttacggatagcggaaacagaaccgccgttgcccaggtggcaggtgataatgttcagttcttctaccggcttgttcagcatttttgccgcttcctgagttacatagaagtggctggtgccgtgtgcgccatagcgacgaacgccatgttctttatacaggctgtacggcagggcatacaggtaagattcttccggcatggtctgatggaaggcggtgtcgaacacggcgacgtttttatctttcagctgcgggaaagatttcagcgcttcggcgataccaatcaggtgagccgggttatgcagcggtgcgaaagaggcggaatctttgatgccctgaatgacggactcatcaatgactacggagctggtatacttctcgccgccgtgtacgatacggtgaccaattgcagttaactgcgcagacagttctggtttttgtgccagaatagtgttaacgataaagttcagcgcttcactgtgagcggcgcctgcacctaaagccgcttcttgtttactgccgtccattttccatttgatgcgtgcttctggcagatggaaacattcggctaaaccagaaaggtattcatcaccattaactgcatcaataattgcaaatttcagtgaagaactaccgcagttcagaaccagtactaacttactcgacatggaagtacctatttatgatacgtggctaaaaaaacgtcagtgagccatagagcgtagcgcatgatagccctgacatttatgattaacatcatgcgcaggagtttttttgggcatgatggaagaaatacctttgagtctatgccattttgcgtatttttcagccaatggcatactatgtgtaatattgacgactcaatgattttaaactaccggcctttgacaggccgacacaggatacctgatagtgggtatcgaagacaaaatgttttgaacgttgtccctcgcagttgttgttttgcacaaattttttaaattttatatgtgaaattgaggtaggccatgtcgacgccggataatcgctccgtaaatttttttagcttatttcgccgggggcagcactacgcgaagacgtggccgatggaaaagcggctggcgcccgttttcgtcgaaaaccgcgtcattcgtatgacgcgctatgccatacgatttatgccgcctgtcgccgtctttacattatgctggcagatagcgctgggcggtcagttaggtccggccgtggcgaccgccctgttcgccctgagcttgcctatgcagggattatggtggttagggaaacgttccttgacgccattgccgccttcaatccttaactggttttacgaagttcgcggtaaattgcaggaggctggacaagcgctggcgccggtagaaggaaagccggattaccaggcattagctgacacgcttaagcgcgccttcaaacaactggataaaactttcttggatgatttgtaattgaccccggattacgcatataaaagaaggcataccaatgccttctttttttcatcgccatagcgtgatacaggagttcaaaatggaaatgaccaacgcgcaacgtctgattttgtctaaccagtacaaaatgatgacgatgctcgatcccaccaacgccgagcgttaccgtcgcttacaaacaattattgaacgcggctacggcctgcagatgcgcgagctggatcgcgagtttggcgagctgacggaagagacctgtcgtaccatcatcgatattatggagatgtaccatgcgctgcacgtctcctggaccaacctcaaagatacgcaagccatcgacgaacgtcgcgtcaccttcctggggtttgacgccgcgacggaagcgcgttacctcggctatgtccgttttatggtgaatatagaaggacgctacactcactttgacgccgggacgcacggctttaatgcccagacgccgatgtgggaaaaataccagcggatgttgaatgtctggcatgcctgcccgcgtcagtaccacctgagcgcgaatgaaatcaatcaaatcattaatgcctgaggaggctcacgtgcagtgtaaaggttttctgtttgatctggatggaacgttggttgactcattacctgccgtcgaacgcgcgtggtgtagctgggccgatcgttttaaccttgctcatgatgaggtgctgggctttattcatggcaaacaggcgatcacctcgttgcggcattttatggcgggtaaatcggaggcggaaattgccgctgagtttacgcgcctggagcaaatagaagccactgaaaccgcagggatcaccgcgttgccgggggcagtcgatttactcaatcacctgaataaagcgggcattccgtgggctatcgtcacctccggttcaatgccggtcgcgcgtgcgcgccatcaggtcgcgggccttccagcgccagaggtgtttgtcaccgccgaacgagtcaaacgcggcaaaccggagccggatgcgtatttgctgggcgcacaactgcttggcctggcccctcaggagtgcgtcgtagtagaagatgccccggctggcgtgctgtccggactggctgcgggctgccacgtcattgcggtcaatgcgccggccgacacgccgcgtctggcggatgttgattttgcgttggatagcctgacgcaattatcggtcgctaaacaaccaaacggcgatgtggtggtgttaagaaagacctgatcatgatatgccccgccctggcggggcatatttatggcagaatcacgttatcttctcatctgacaaggatatgttgtgaacggtgaattgatttgggttctctctttactggcgattgccgtcgtgttgtttgcgacgggcaaagtacgtatggatgcggtggctttattcgtcattgttgcttttgtccttagcggtaccttgaccctttcggaagccttctccggctttagcgatccgaatgtcattcttatcgccgccttatttattattggcgacggcctcgtgcgcaccggcgttgcgacggtggtcggtacctggctggttaaaatggcgggcagcagtgaaatcaagatgctggttttactgatgatcaccgtcgccggacttggtgctttcatgagttcaaccggcgtggtggcgatttttatccccgttgttcttagcgtttctatgcatatgcagacctcgccttcgcgcctgatgatgccgctgagttttgccgggcttatcagcggaatgatgacgctggtggcgacgccgtcgaacctggtggttaacagtgaactgctgcgtgaaggcctgcacgggttcaacttttttagcgtgacgccgctgggggtagtggtgttggcgctcggcattgtttatatgctggtgatgcgcttcatgctaaaaggcgatgcgcccggacaacaggccggtaagcgtcgcactttccgcgatcttatccgcgagtaccgtctgacggggcgcgcgcgtcgtctggcgattcgccccggttcgccgatggtgggacagcggctggacgaccttaaactgcgcgaacgttacggcgccaatgtcatcggcgttgaacgctggcggcgctttcggcgggttatcgtcaatgtgaacggcgtatcggagtttcgcgctcgcgacgttctgctgattgatatgtcggcggcggaggttgacctcagagagttctgcgccgagcaactgctggaaccgatggtattgcgtggagaatatttttccgatcaggcgttggatgttggcatggcggaaatttcgcttattccgaagtctgaactgataggcaagtcggtgcgtgaaatcgccttccgtacacgttacgggctgaatgtggtcggcctgaaacgcgacggcgtcgcgctggaagggtcgctggccgatgaaccgttattgatgggcgatatcattctggtcgtggggaactggaagttaatcagcctgctggggcaaaaaggccgcgactttgtggtgctgaatatgccggtcgaggtcagcgaagcctcgccggcgcacagccaggcgccgcacgccattttctgtctggtactgatggtggcgctgatgttgaccgatgaaattcccaatccgagcgcggcgattatcgcctgcctgctgatggggaaatttcgctgtattgatgctgaaagcgcgtataaagcgatccactggccgagtattatcttgattgtgggtatgatgccgtttgcgctggcgttgcaaaaaaccggcggcgtctctctggtcgtgcaagggttaatggatatcggcggcggctatgggccgtatatgatgctgggatgcctgttcgtgctgtgcgccgtcataggactgttcatttctaacacggcaacggcggtgctgatggcgccgattgcgctggcggcggcgaaatcgatgggggtgtcgccctatccgtttgcgatggcagtagcgatggcggcatccgccgcctttatgacgccggtttcatcgccggtcaatactctggttctggggccgggaaactatagctttagcgattttgtgaagcttggcgtgccgttcacgcttattgtgatggcggtttgtattgtgatgattccgatgttgtttccgttttaaccccaggctggaaaaggcctgatggcgctacgcttatcaggcctacgggaagaacggtaggccggataaggcgttagccgccatccggcaactaaagcggtgaatcctggcttatctcgtcaagagagagatggaaacttggcacgaacaccgccataaaatagtccatctcctggctgcgacgtaattccagcgttttttccagccgcgtttttgccagtctaaactcattatttcccgctgagagctcctccaggcatttcaggtaggcgcaaagcgcatcggcctgctttacgattgcctgttcttctttgctccaggcattctcatcaataagcggtgcgaaaatatcgtgtaattcatccggcgccatatcaaccagcttttgctgggcgattttttcgatcgctttatattcctgagctatctgggaattaaaatattttaccggcgttggcagatcgccggtcagtacttccgaggcatcatgatacatcgccagaagcgcgatgcgttcagcattgagctggccgccaaatttacggttttttatcgccgccaacgcatgggcgaccatcgccacctgcagactatgttcggagacgttttccgtacgcacgttacgcatcagcggccagcggttaatcaacttcatgcgggagagatgggcgaaaaaatggctctgcttcatagattaccttttgttttcactgcggcagacttcattgtgcggggagggtgatgaagatgcaattcaggctaccgaagtagcctgaatttaagattattgatggtagcctgagaggaaacgcccaaagcggttgatggccatctccaggtcatcttcacgcggtagcgtcacaatgcggaagtgatccggccacggccagttaaaggcggtaccttgcaccagcagcaccttttcctgtagcaggaagtccagcaccatcttctggtcgtcgtgaatattaaaacgtttagcgtcgatcctggggaacatgtacaacgcgccgcgcggttttacgcaggaaacgccgggaatatcgttaatcaactcccaggcgcggttacgctgttcatacagtcgaccgcccggcagaataaattcgctaatgctttgatagccgccgagcgcggtctgaatagcatgttgcgccgggacgttggcgcacaggcgcattgaggctaacatctccagcccttcaatatagcctttcgcatgttttttcggcccgttcagcaccatccagccctggcggaagccggcgacgcgataggttttagacaaaccattaaaggtgatggtcagcagatcaggcgccagtgcggcgatagagtgatgttcggcatcgtcatagagaatcttgtcataaatttcatcggcgaagatgatgagattatgctcgcgcgcaatgttgacaatttccatcagcaattctttagaatagacggcgccagtagggttgtttggattaataatgacaataccacgcgtacgtggggtgattttggcgcggatatcgtcaaggtccgggaaccagtcggaagattcatcgcaaagataatgtaccgccttgccgctggagagcgataccgctgctgtccataacggataatcgggcgcgggaaccagcatttcatcgccactgttaagcaacgcctgcatcgcctgaacgatcagctcggaaacgccgttaccgatatagatatcttccacggttacatcgcgcattccacgggcctgataatgctgcataatcgctttacgggcggaataaagccctttcgagtcgcaatatccttgcgccgtcggcaaattacgaatgacatcgaccagaatttcgtccggcgcttcgaatccgaagggggcggggttgccgatattcagtttaagaactttattaccttcttcctcaaggcgtttcgcttctttcagaacggggccacgaatgtcataacagacattttcgagtttgctggatttttcaatgggggacatgaatcttgaccttttagctgttattgccactccctgccgtggaagtcagcacgaaacaatgtactcccacgacggtgagttttgaagagtgaacagaagaagattttgtttatttttaacgcgctttcgtactgtttaaaacttcataaaatcatttggttagatgcattttctatttttgtctgtatgtatagtgttttgttctatgtggttgcgcgtaatgtggttttttatgttgtcagaaattatctgttttatgagagataagcattcatcattagtgtcgcgtcggctatttcggaaatactgagtattaaaggtaaaatgagaaggttagacctttccggcggcgggtggtgtgaaactattgttaagtataattaatgaatggtagaaatcttaattaattattatttaatatttaaaaagcatttactaaagtcgtaataatatctttctggtcggattagtataacatatcccaggttaagattattcgtaataatacttataaatatagcggttttaggttaagataatgatccgaaacgggggcgtagtctgcgttgtctgctaattatcatgacgcgattttatacataacctattgttcaatatattgtttttgtatctgtgcgtctcggtaaactatttgacgctgttacaagatttacacgtccatcattagcagaaatctgtagacgcctaaaggtatgacacattctctttgatatatcccgatcagttgcatttggtattatatcagtaagtaagagaagtgttttggtcgtattttcaattacattctaacatttacctgggtaaccaggcggtactgcgaaggatgcacattacaaatggaattgcttgtttctgaatgcacagcattaaccaggtcagcccgatatgacccgtcagtaagtgaaaaattatgataaatgcaaatcgtccgataattaacctcgatctcgatctgctgagaacgttcgtggccgttgccgatctgaacaccttcgccgcggcggcggcggcggtatgtcgtactcagtctgcggtcagtcagcaaatgcagcgtcttgagcaactcgtgggaaaggaattgttcgcccgccatggtcgtaacaaacttttgagcgaacacggtatccagcttctggggtacgccagaaaaatcctgcgttttaatgatgaggcgtgttcatcattaatgttcagtaatcttcagggagtgttaacaatcggcgcttctgatgaatcagctgatactatcctgccttttttgcttagccgaatcagctcggtttatccgaaactcgcgcttgatgtacgggtaaaacgcaacgcctatatggtggacatggttaaatcgcaggaagtagatttggtggtgacgactaaccaacctcattcgctggactgtctgaatttgcggacctcgcccacccattggtattgtgcggctgagtatgttttgcaaaggggagagcccgtaccattagtcctgctggacgatcccagcccattccgcgatatggtgctggagacgctaaatgcagcgggtattccctggcggctggcctatgtggcctctacattactggcggtacgcgcggccgttaaagccggtcttggcgtaacggctcgacctgtcgaaatgatgagtcccgaccttcgcgtgctgggcgccgcagatggattaccgcctttgctggatacggaatatatgttgtgccgcgatcccaatagccagaacgagctggcgatggtgattttccatgcgatggaaagctatcaaaacccatggcattacaaccagttttctgcagagggcggagatgatccgctgatggtggaagggggttttgagtagctcgcaggcaaaaggcgctaagtcgtaaatgtaaaaaagagccgctggcgatgaaaaaacgctcagtggctctttttttgtgcccatctgtacgcgcttaaccgcacaaattgtaaaagttgcggtaaatcagccagtagcgattcgcagttcaatgtgggcaaaaaataaccagaacatccattttatgaatttgcatgttaaaaaactagagaaattgttgctgttttagggggtgaattaacaaaagcgtgtcacagatcaagaaaatactcccatttagggggaggcatcttcacaaattcctgtcaaaataggtgtgtgttatttcttttgcttcacaacggacacgattcaacaacataaaatctcccctggtcgaagagtcattttctccaggatggcacttaatgttaatgatgatgaattgatgtaaattaatgtgaaggaacttttgttaaagttgacaaaaggttatagaaaggagtaaaaaaccacatcaattagctgtttttatcattttctacagtaattgtagggtttttttattcctcccctgaatcgatgtggcgtccatctgccgtaaagagcagaggaactggcgctacttttgatgagtaagcaatgagtatgtcaacatccactgaagtcatcgctcatcactgggcattcgctatctttcttatcgttgccattggcctgtgctgcctgatgctggtaggcggttggtttttgggcggtcgcgcacgcgcgaggcacaagaacgttccgtttgaatcaggtatcgactcggtcggcaccgcccgcttacgcttgtctgccaagttttacctggtagccatgttcttcgttatcttcgacgttgaagcgctgtatctgttcgcatggtcaacttctatccgcgaaagcggctgggttggctttgtggaagctgcaatttttatttttgtgttactggctggtctggtttatctggcgcgtattggcgcgttggactggacgcccgcgcgttcacgccgcgagcgtatgaacccggaaacgaacagtatcgctaatcgtcaacgctaaccgcgaggcattaagatggattatacgctcacccgcatagatcctaacggtgagaatgaccgttaccccctgcaaaaacaggagatcgtaaccgaccccctggagcaggaagttaacaaaaacgtgttcatgggcaaactgcatgacatggttaactggggccgtaaaaactcaatttggccctacaacttcggcctttcttgctgctatgtagagatggtgacctcgtttaccgcagtgcatgacgttgcccgtttcggcgcggaagtgctgcgtgcgtcgccacgtcaggctgatctgatggtggtggccggtacctgctttaccaaaatggctccggttattcagcgtctgtatgaccaaatgctggagccaaaatgggtcatttctatgggcgcctgcgccaactccggcggcatgtacgatatttattcggtagtgcagggcgttgataagtttatcccggtggatgtgtatatccctggctgtccgccgcgtccggaagcgtatatgcaagcgttgatgctgctgcaagaatcgattggcaaagagcgccgtccgctctcatgggtggtgggcgatcagggcgtgtatcgcgccaatatgcagccagaacgcgaacgtaaacgcggcgagcgtattgccgtcacgaacctgcgtaccccggacgagatttaatttgcgcctgtcggcagcagcacttcacttcgctaaccactattttaatagcgcgaagcactgccgaccaccacggaccatttgcaatggtgaacaatatgaccgacttaaccgcgcaagacgctgcatggagtacccgcgatcatcttgatgatccggttatcggcgaactgcgcaaccgttttgggccggatgcctttaccgttcaggcgacccgcaccggtatccccgttgtttgggtcaagcgtgaacaactactggaggttggcgatttcttaaagaaactgccgaaaccttacgtcatgctgtttgacttacacggcatggatgaacgcctgcgtacgcaccgtgacgggttacccgccgcggatttttccgttttctaccacctgatttccattgagcgtaatcgcgatattatgctcaaggtggcgttgtctgaaaacgacctgcgcgtgccgaccttcactaaacttttccctaacgccaactggtacgagcgtgagacctgggagatgtttggcattgatatcgaaggccacccgcacctgacgcgcatcatgatgccgcaaacctgggaaggccatccgctgcgtaaagattatccggcgcgcgcgaccgaattcgacccgtttgagctgaccaaagccaagcaggatctggagatggaagcgttgacctttaagccggaagactgggggatgaagcgcgggactgacaacgaggactttatgttcctcaacctcggcccgaaccacccgtctgcgcacggtgcgtttcgtattatcctgcaacttgacggcgaagaaatcgtcgactgcgtgccggatatcggctatcaccaccgcggcgccgaaaaaatgggcgagcgccagtcctggcatagctacattccctataccgaccgtatcgaatacctcggtggttgcgtcaatgaaatgccgtacgtgctggcggtagaaaaactggcggggatcaccgtcccggatcgtgtgaacgtcatccgcgtgatgctctccgaactgttccgcattaacagtcatctgctgtacatttcgacctttattcaggacgtcggcgcgatgaccccggtcttctttgcctttaccgaccggcagaaaatttatgatctggtggaagccattaccggtttccgtatgcacccggcctggttccgtatcggcggcgtcgcgcacgacttgccgcgcggttgggatcgcctgctgcgagagttccttgagtggatgccgaagcgtctggactcttacgagaaagccgcgctgcgtaacaccattctgaaagggcgttcgcagggcgttgccgcttacggcgcgaaagaggcgctggagtggggcaccaccggcgcagggctgcgcgcgaccgggatagacttcgacgtgcgtaaatggcgtccatattctggctacgaaaactttgactttgaagtgccggtgggcggcggcgtttccgactgctatacccgcgtgatgctgaaagtggaagagctgcgccagagtctgcgcattcttcagcagtgcctcgataacatgccggaagggccgttcaaagcggatcacccgctgaccacgccgccgccgaaagagcgcacgctgcaacatatcgaaaccctgatcacccacttcctgcaggtctcctggggcccggtgatgccggcgcaggagtccttccagatggtggaagcgacgaaggggattaacagttactacctgaccagcgacggcagcactatgagctaccgtacccgcgtgcgcacgccgagctttgcgcacctgcagcagattccctcggcgatccgcggtagcctggtctccgacctgattgtctatctgggtagtatcgattttgttatgtcagatgtggaccgctaattatgcacgagaatcaacaaccacaaaccgaggcttttgagctgagtgcggcagagcgtgaagcgatagagcacgagaagcaccactacgaagacccgcgtgcggcgtccattgaagcgctgaaaatcgttcagaagcagcgtggctgggtgccggacggcgcgatctacgctattgccgatgtgctgggtattccggcgagcgacgtcgaaggcgtcgccacattctacagccagatcttccgtcagccggtcggtcgccacgtgattcgctactgcgacagcgtggtgtgccatatcaccggctatcaggggattcaggccgcgctggaaaaaaatctcaacatcaaaccggggcagacgacctttgatggccgctttacgctgctgccgacctgctgcctggggaattgcgataaagggccgaacatgatgattgatgaggatactcacagccatctgaccccggaagccattcctgaactactggagcggtataaatgaaaaacgttatccgtactcccgaaacccatccgctgacctggcgtctgcgcgatgacaaacagccggtctggctggatgaatatcgtagcaaaaacggctacgaaggcgcgcgtaaggcgctgaccggcctgtctccggatgaaatcgtcagccaggtaaaagacgctggtctgaaagggcgcggcggcgcgggcttttccaccggtctgaagtggagcctgatgccgaaagatgaatccatgaacatccgttacctgctgtgtaacgccgatgaaatggagccgggcacctataaagaccgtctgctgatggaacaactgccgcacctgctggtggaaggcatgctgatctccgcgttcgcgctgaaagcgtatcgtggttacatcttcctgcgcggcgaatatatcgaagcggctgtacatctgcgccgtgcgattgccgaagcaaccgaggccgggctgcttggcaaaaatatcatgggcaccgggttcgacttcgaactgtttgtccacaccggggcagggcgttacatctgtggtgaagaaacggcgctgattaactccctcgaaggccgccgcgcgaacccgcgctccaagccgcctttcccggcgacctccggcgtatggggcaagccgacctgtgtgaataacgtcgaaacgttgtgtaacgtcccggcaatcctcgccaacggcgtggagtggtaccagaacatctcgaaaagcaaagatgcgggtaccaagctgatgggcttctcgggccgcgtgaagaatccgggcctgtgggaattaccgttcggcaccatcgcgcgcgagatcctcgaagactacgccggcggtatgcgtgacggcctgaaattcaaagcctggcaaccgggcggcgcggggacagacttcctgaccgaagcacacctcgatctgccgatggaattcgaaagcatcggtaaagcggggagccgtctgggcaccgcgctggcgatggcggtagaccacgaaatcggcatggtgtcgctggtgcgtaacctggaagagttctttgcccgcgaatcctgcggctggtgtacgccatgccgcgacgggttgccgtggagcgtgaaaattctgcgcgcgctggagcgtggcgaaggccagccgggggatatcgagacgcttgagcaactgtgtcgattcctcgggccgggtaaaaccttctgcgcgcatgcgccgggcgcggttgagccactgcaaagcgcaattaagtatttccgcgaagaattcgaagctggcatcaagcagccgttcagtaatacccatttaatcaatggtattcagccgaacctgctcaaagagcgctggtgagttaacgatttttaatttggaagcatgctaatggctacgattcatgtagacggcaaagaatacgaggtcaacggcgcggacaacctgctacaggcatgtctgtccctcggccttgatattccgtatttttgttggcacccggcgctgggaagcgtcggtgcttgccgccagtgtgcggtgaagcaataccaaaacgcggaagatacgcgtggtcgcctggtgatgtcctgtatgacgccagccaccgacggtacctttatctctattgacgacgaagaagcgaaacagttccgtgaaagcgtggtggagtggctgatgactaaccacccgcacgactgtccggtctgtgaagagggcggtaactgccatcttcaggatatgaccgtgatgacgggtcacagtttccgccgctaccgtttcaccaaacgtacccaccgcaaccaggatctggggccgttcatctcgcacgaaatgaaccgctgcatcgcctgctaccgttgtgtacgttactacaaagattatgctgacggtaccgatctgggcgtctatggcgcgcatgacaacgtctacttcgggcgtccggaagacggtacgctggaaagcgaattctccggtaacctggtcgagatttgcccgaccggcgtcttcaccgataaaacgcactccgagcgttacaaccgtaaatgggacatgcagtttgcgccgagcatctgccagcagtgttccatcggctgtaacatcagcccgggcgagcgctatggcgaactgcgccgtatcgaaaaccgttacaacggtaccgttaaccattacttcctctgcgaccgcggtcgtttcggctatggctatgtgaacctgaaagaccgcccgcgtcagccggttcagcgtcgtggcgatgactttattactctcaacgccgagcaggcgatgcagggcgcggcggatattctgcgccagtcgaagaaagtgatcggtatcggttcgccacgcgccagcattgagagcaactttgcgctgcgtgagctggttggtgcggaaaacttctacaccggtatcgcgcgcggcgagcaggaacgtctgcaactggcgctgaaagtgctgcgtgaaggcggaatttacaccccggcgctgcgggagatcgaatcttatgacgcggtactggtcttgggtgaggatgtcactcagaccggcgcgcgcgttgcgctggcggtacgccaggcggtgaaaggtaaagcgcgtgaaatggcggcggcgcagaaagtggccgactggcagattgcggccatccttaacatcggccagcgtgccaaacatccgctgttcgtgactaacgtggacgacacccgtctggatgatatcgccgcctggacttatcgcgcgccggtggaagatcaggcgcgcctgggctttgcgattgctcatgcgctggacaatacagcgcctgcggttgacggtatcgacagcgacttgcaaaacaaaattgatgtcattgtgcaggcgttggccggcgcgaaaaaaccgctgattatctccggcactaacgccggtagcagtgaggtgattcaggcggccgccaacgtggcgaaagcgctgaaaggccgtggcgccgacgtcggtattactatgattgcccgctccgtgaacagcatggggctgggtatgatgggcggcggttcgcttgacgatgcgttgggcgagctggaaaccggcagcgcggacgcggtggtggtgctggaaaacgatctccaccgtcatgcaagcgctacgcgcgtgaacgccgcgctcgccaaagcgccgctggtgatggtggttgaccatcagcgcacggcgattatggaaaatgctcatctggtgctttccgcggcaagcttcgccgaaagcgatggtacggtcatcaacaacgaaggccgcgcgcagcgcttcttccaggtttatgacccggcctactacgataacaagacgattatgctggaaagctggcgctggctgcattcgctgcacagcaccgtcgaaaaccgcgaagtggactggacacagcttgaccatgtgatcgacgcggtcattgccgccatgccgcaatttgccggcattaaggacgccgcgccggatgcgaccttccgcattcgtgggcagaagctggcgcgcgaaccgcatcgttacagcggtcgtacggcgatgcgcgccaatatcagcgtgcatgaaccacgtcagccgcaggataaagacaccatgttcgccttctcaatggaagggaataaccaaccgactgccccgcgatctgaaattccgttcgcctgggcgccgggctggaactctccgcaggcgtggaacaaattccaggatgaagtgggcggcaaactgcgtcacggcgatccgggcgtgcgtttgattgaagcgactgagggcggtctggattatttcactaccgtgccggcaagcttccaggcgcaggacggtcagtggcgtattgcgccgtattaccacctgtttggcagcgacgaattgtctcagcgttctccggtcttccagagccgtatgccgcagccgtatatcaaacttaacccggcggatgctgcgaagttgggcgtcaatgccgggactcgcgtctcctttagctacgatggcaatacggtgacgctgccggttgaaatctctgaagggttagcggcagggcaggtagggctgccgatgggtatgcctggcatcgcgccggttctggctggcgcgcgtcttgaggatctgcgggaggcgcaacaatgagttggattacaccggatctgattgagatcctgctgagcattctcaaagcggtggtgattctgctggtggtcgtcacctgcggggccttcatgagctttggcgaacgtcgtctgctgggtctgttccagaaccgttatggaccaaaccgcgttggctggggcggttcgctccagctggtcgcggatatgatcaagatgttctttaaagaagactggatcccgaaattctcggatcgcgtcatctttaccctggcgccgatgatcgcgtttacttcgctgctgctctccttcgccattgtgccggttagccctaactgggtggtggccgatttaaacatcgggattttgttctccctgatgatggccggtctggcggtttacgcggtactgttcgccggttggtcgagcaacaacaaatactcgctgctgggcgcgatgcgcgcgtctgcccagacggtgagctacgaagtgttccttggtctttccctgatgggcgtggtggcgcaggccggttcatttaatatgaccgatatcgtcaataaccaggcgcatctgtggaacgtgattccgcaattctttgggtttgttactttcgccatcgcgggcgtagcggtctgtcaccgtcacccgtttgaccagccggaagccgagcaggaactggcggacggttaccacatcgaatattccggtatgaaattcggtctgttcttcgtgggggagtacatcggcatcgtcaccgtttccgcgctgatggtaacgttgttcttcggtggctggcatggcccgttcttaccgccattcgtctggttcgcgctgaaaaccgcgttcttcatgatgatgttcattttgattcgtgcgtcgttaccgcgtccgcgttatgaccaggtaatgtccttcggctggaaagtttgcctgccgctgacgctcatcaacttgctggtaacggcggctgtcattctgtggcaggcgcaataagggacacaaagaccatgaccttaaaagaattattagtaggtttcggcactcaggtacgcagtatctggatgatcggcctgcatgcgttcgcgaaacgcgaaacgcggatgtatccggaagagccggtctatttaccgccccgttaccgtggccgtatcgtgctcacgcgcgacccggacggtgaagagcgctgcgttgcctgtaacctgtgcgcggtagcctgtccggtaggctgtatctctctgcaaaaagcggagaccaaagatggccgctggtatccggaatttttccgcattaacttctcacgctgcatcttctgcggcctgtgcgaagaagcgtgcccgaccacggcgattcagttgaccccggacttcgaactgggcgaatacaaacgtcaggatctggtgtacgaaaaagaggatctgctgatttccggtccgggcaaatacccggaatataacttctaccggatggcgggtatggcaatcgacggcaaagataaaggcgaagcagagaacgaagccaagcctatcgacgtcaagagcctgttaccgtaaggagagggcaatggaattcgctttttatatctgtggcctgatagccatcctcgcgaccctgcgagtgatcacccataccaatccggtacacgcgctgttgtatctggtgatatcgctactggcgatttccggggtgttcttttcgctgggcgcttactttgccggtgcgctggaaattatcgtctacgcgggtgccattatggtgctgtttgtgttcgtggtgatgatgctcaacctcggcggcagcgaaatcgaacaggaacgccagtggctgaagccgcaggtgtggattggtccggcggttttgtcggccattatgctggcggttattgtgtacgccattctgggcgttaacgaccagggcatcgacggcacgccgattagcgcgaaagcggtgggcattacgctgttcgggccttatgttctggcggtcgaactggcgtctatgctgctgctggcaggcctggtggtggcgttccacgtcggtcgtgaagagcgtgcgggcgaagtgctaagcaaccgcgccgatgaccgcgcgaaaagaaaaacggaggagcgcgcatgatccccttaacacacggactgatcctcgctgcgattttattcgtcctgggtttaaccggtctggttatccgccgcaatctgctgtttatgctgatcgggctggaaatcatgattaacgcctccgcgctggcctttgtggtcgccgggagctactggggccagaccgatggtcaggtgatgtacattctcgccatcagccttgcggctgcggaagcgagtattggacttgcgctgttgctgcaactccatcgccgtcgccagaacctgaacatcgattcagtaagtgagatgcgtggatgaacatgcttgccttaaccattattctgccattgattggctttgtactgctggcgttctctcgcggacgctggtcggaaaatctctccgcgaccattggcgtgggctccgttggtctggcggcgttggtgacagcgtttgtcgggatggatttcttcgccaacggcaaacaggcgttcagccagccgctgtggacgtggatgtcggtcggtaacttcaacatcggttttaacctggtgctggacggcctgtcgctgaccatgctctctgtggtcaccggcgtcggcttcctgatccacatgttcgcttcctggtacatgcgtggagaagagggctactcccgcttcttcgcttataccaacctgtttatcgccagcatggttgttctggtgctgtccgataacctgctgttgatgtacctcggctgggaaggcgtgggcctgtgctcttatctgttgatcggcttctattacagcgatccgaagaatggcgcggcggcaatgaaagccttcgtggtgacccgtgtcggtgacgtattcctcgccttcgcgctgttcatcctctacaacgaactgggcacgctgaacttccgcgaaatggtcgagctggcgccagcgcactttgctgacggcaacaacatgctgatgtgggcgacgctgatgctgctgggcggcgcggtcggtaaatctgcgcagctaccgttgcagacctggcttgccgacgcgatggccggtccgacgccggtctccgcgctgatccacgccgccaccatggttaccgccggtgtctacctgatcgcacgcacgcatggcctgttcctgatgaccccggaaattctgcatctggtgggcattatcggggcgattacgctggtcatggcgggtttcgccgcgctggtgcagaccgacatcaaacgcgtgctggcctattccaccatgagccagattggctacatgttcctggcgcttggcgtgcaggcgtgggatgcggcgattttccacctgatgacgcacgccttctttaaagcgctgctgttcctggcatccggctcggtaattttggcctgccatcacgaacagaacatctttaagatgggcggtctgcgtaagtccattccactggtgtatgcctgcttcctggtggggggcgcggcgctgtcggcgctgccgctggtcactgcgggcttcttcagtaaggatgagatcctggctggcgcgatggcgaacggtcatatcaatctgatggtggcgggtctggttggcgcgttcatgacctccctgtacaccttccggatgattttcatcgtattccacggtaaagaacaaattcatgctcatgcagggaaggggattacccaccatctgccgctgattgtcctgatgattctgtctacctttgttggcgcgctgattgtgccgcctctgcagggggtgctgccgcagacaactgaactggcgcatggtcgtgtgttgaccctggaaattacctctggcgtagtggcgattgccggcatcctgattgccgcatggctgtggctgggtaaacgtacgctggtgacgtcgatcgccaacagcgcgccgggccatctgctggggacctggtggtataacgcctggggctttgactggctgtacgacaaagtattcgtcaagccattcctcggtatcgcctggctgctgaagcgcgacccgcttaatgcgttgatgaacattccggctatcctttcccgttttgcaggcaaaggcctggtactgagcgagaacggttatttgcgctggtatgtggcatccatgagcatcggcgcggttgtggtgctggcgctgctgatggtactgcgttgagtttgttggctggatgaacgactgccggatggcgcagtgcttatccggcctacaaacccaaaaataatttttagaattcgttgaaaatctgttcctgaagtacaggcgtcatcggcgaagtcagaccggataccgccagcgcacagcaaccggagcgtactgaagtacgtgaggatgattcgcgaagctcacccctacggggccgtccttacggacgttcaaaacgcgctgcgttttgtgtgagcactggcaggatttgggctgacgagtgagatagcctgagcaggagtaaatataagggacatacttagctatgttattaccctggttgatattaatcccctttatcggcggctttctgtgctggcagaccgaacgctttggcgtgaaagtgccgcgctggatagcgctgattaccatggaactgacgctggcgctcggtctgcaattgtggttgcagggcggctactcactgacgcaatccgccggtattccacagtggcaatctgaatttgtcctgccgtggattccgcgttttggcatctctatccatctggcgctcgacggactgtcgctgctaatggtggtgctgaccggcctgctcggcgttctggcggtgctttgctcttggcgagaaatcgaaaaatatcagggcttcttccacctcaacctgatgtggatcttaggcggcgttatcggcgtgttcctggccatcgacatgttcctgttcttcttcttctgggaaatgatgctggtgccgatgtacttcctgatagcgctgtggggccacaaagcttctgacggtaaaacgcgtatcacggcggcaaccaagttcttcatttacacccaggcgagtggtctggtgatgttgattgccatcctggcgctggtgtttgtgcactataaagcgaccagcgtgtggaccttcaactatgaagagctgctgaataccccgatgtcccacggtgtggaatatctgctgatgctgggcttcttcatcgccttcgcggtgaaaatgccggtggttccgctgcatggctggctgccggatgcgcactcccaggcgccgaccgccggttccgtcgacctggcggggatcttgctgaaaaccgccgcttacggtctgctgcgtttctccctgccattgttcccgaacgcgtcggcggagtttgcgcccatcgccatgtggctgggcgtcatcggcattttctacggcgcgtggatggcctttacccaatacgacatcaagcgcctgattgcctatacctccgtttcccacatgggcttcgtgctgatcgctatctacaccggcagtcagctggcgtaccagggcgcggtgattcagatgattgcacacggtttgtccgcagccggtctgttcattctgtgtggccagttgtacgaacgtctgcatacgcgtgacatgcgtatgatgggcggcctgtggggcaagatgaagtggttgcctgcgctgtccatgttctttgcggtggcgacgctcggtatgccgggcaccggtaactttgtcggcgaatttatgattctgttcggcagctatcaggtggtgccgatgattaccgttatctcgacctttgggctggtattcgcctctgtatactcgctggcgatgctgcatcgcgcttactttggtaaagcgaagagccagattgccagccaggaactgctagggatgtcgctgcgcgagctgtttatcattctgttgctggtggtgcttctggtactgcttggcttctatccgcagccgattctggatacctcgcattctgcgatgagcaacatccagcagtggtttgttaattccgttactactacaaggccgtaaatcgccatgacaataactccacaacacctgattgcgctgctaccgctgctgatcgtcggcttgacggtggtggttgtgatgctctccattgcgtggcgacgcaatcacttcctcaatgccacgctgtcggtcattgggcttaacgctgctctggtttcgctttggtttgtcggccaggccggggcaatggacgtcacgccgctgatgcgcgttgacggctttgcgatgctctacaccgggctggtgctgctggcgagcctcgccacctgtacttttgcctacccgtggctggaaggctataacgataaccaggaagagttctacctgctggtgttaatcgccagcctggggggaattctgctggcgaacgccaaccatctggcggcgctgttcctcggtattgaactgatctcactgccgctgttcggcctgattggttatgctttccgccagaaacgctcgctggaagccagtatcaaatacaccatcctctccgccgccgcctcgtctttcctgctgttcgggatggcgctggtctatgcgcagtccggcaacctgtctttcgaagcgctcggtaagagcctcggcgatggtatgctgcacgagccgttgctgctggcgggctttggcctgatgattgtcggtctgggctttaaactctctctggtgccgttccacctgtggacgccagacgtttaccagggcgcgcctgcgccggtttctaccttcctggcgacggcgagcaaaatcgctatcttcggcgtggtaatgcgtctgttcctgtatgcgccggtaggcgacagcgaagcggtacgcgtggtgctgggcattatcgcctttgcctctatcatcttcggtaacctgatggcgctgagccagaccaacatcaaacgtctgctcggttactcttctatctctcacctcggctatctgctggtggcgctgattgccctgcagagcggcgagatgtcgatggaagcggtaggcgtttatctggccggttatctgttcagcagcctcggcgcgtttggcgtggtcagcctgatgtccagcccgttccgcggcccggatgccgactccctgtactcttaccgtggtctgttctggcaccgtccggttcttgccgcggtgatgacggtgatgatgctgtcgctggcaggtatcccaatgacgctgggctttatcggcaaattctacgtgctggcggtcggcgttcaggccagcctgtggtggctggtcgccgccgtggtggtgggttccgcgattggtttgtactactacctgcgcgttgcggtgagtctctacctgcacgcgccgcagcaaccgggacgcgacgcgccgacaaactggcagtacagcgcaggcggtatcgtggtgctgatctccgcgttgctggtgttggtactgggcgtctggccgcagccgctgattagccttgtgcagttagcgacgccgttgatgtaagcaataagtaaaaacgaaaaacccgcttcacgaagcgggttttttattacctgatgtcattctttaaaatgactcaggacggtagaccggataaggcgtttgcgccgccatccggcctgtaaggtctcagcgaccggaatttaacttagcaactgccggcttaccagcgggccgctgatgttttgcgccgcgcgttccatcacttcctgtatcactgaagagagttcgttaatctcaaacttggccacgtagccgtcggctttcaccttacgcacatgatcttcgttggcgctgccggaaagggaagagtgaataacaaccgggatctttttcagccgttcatcggttttaattttacgcgttaacgtaaagccatccatctccggcatctcaaggtctgtcaggactagcgcgattttctcgctaattggcttaccttcggcctccgcttcctgcgccagttgctggattctctcccaggcatccttgccggtcacatgcatctgatgcggaatttccatcgcgttcagccctttttccagcatcgcgcaggcgactttggagtcttccgccacaatggcaaccgcgccgggggtaatataaaatttattggtcttcagattggtggcgcgcagatcgtggctggaggggacaatatcataaaggatctgctcaacgtcgagcaccagcgccaggttgttggtttctttgttgtcatccaggcaggcaatactggtgatgtagcgaccgttgacggctttctcggcggtatgcacctgttgccagtcaagacgcataatattttccaccgactcgacggcaaatgcctgtacgctgcgcacatattcggtgatcagcaaaatattcagcccggtttccggcttgcagcccgctaccgctggcaaatcaatcaccggaatgacctgatcccgaatattgaccatgcccaatagcggcgctttcatgcctgccgggcgcgtaaaggcgggcataggtatgatttcgcgcagcttaaatacattgataccgaacagctctgacttctgttcatgcagcgatgtaccaagacggaataacagcagttcaaaacggttggacagggttaaattggccctgtcatcaatatctttctgaaaattgtccatcctaacctcattatgaaagcctgccttttttagtgttatcggcaatgaggacaaaaaatggagcgctaaaccgggaaaacagaaaaatcgtaagccagctccgtcgccgggaaaatagcgcggcattccgccagtaagcgctgacagcctttatcgtcatagcgtgagctaatgtgggtcatgatcagccgaccaacggcagcctcccgcgccagcgtcgcggtttgacgggtggagctgtgtccgcgagcgttggctttctcctccattgacgcatccagcgtggtttcatgaaccatcacatccacaccctgcgccagtgcgagggcggcctcgcagggcgcggtatcgccgaaaatcgccactgatttcccggccacggcgggagcaaggtagtcggcgccattgatctgccttccatcggcaagcgtgacggtttttcctgccttcaacgcctgaaacagcgggccgggcgtaacgcctgcggcttttaacgccctggcattcagcgcgccaggcttgtcatgttcaacaacgcgatatccgtagcactccagtggatgctccagcctgaatgcggtcactttacgcagaccgtcgtcaagaatatcgccagcgctaatttcttcaatttgcaacggaaaatcggtccatgaaccgctaaggcgcagtgtggttgcaataaactcacgcacgccttgaggcccgtatacggttagcggatggggattccccgccatcgaccggctgcatagcagacccggcaggccaaacagatgatcgccgtgaagatggctgataaaaatgcgctcaagcttaccgggatgaaacgcggtattaagcatttgatgctgtgtcccttcgccgcaatcaaaaagccatactcccggctgcgttggatgttgcagatgtaataaaattgccgttacattgcgtgagcgtgtgggaacgcctgcggacgtacctaaaaaaattaattccatcttgtccatacgcgtttggttatcgtttaacccaagattaccacaacacaggagcgcatcatgattgactggcaggatctccaccatagcgaacttactgttcctcaactttacgcgttactcaaattgcgctgcgcggtctttgtggtagaacagcgctgtccttacctggatgtggatggcgatgatttagtcggcgacaatcggcatattctgggctggcatcaggatgagctggtggcgtatgcgaggattctgaaaagtgataacgaatcagacccggttgtcattggccgggtgatcgtcagcgatgcctggcgaggggcgaaactgggccagcaattaatggcgaaaacgctggaatcttgtgggcggcactggccggataagccgctatatctgggggcgcaggcgcatctgcaacctttttatgcgcggtttggttttattcccgtcaccgatgtttatgacgaagacggcattccgcaccggggaatggcgcgggaggttcatcaggcataaaccgaaaccgttgactatagttaggagcaggtgttaacacaacggagaatgagaatgtcatatcaatttggtgaatcacgtgttgatgatgatctgactttgctcagcgaaacgctggaagaggttttacgttcctcaggcgatcccgccgatcaaaaatacattgagctgaaagcccgcgcggaacaagcgctggaagaggtgaaaaaccgcgtaagccatgcgtcggatagctattattaccgggcaaagcaggccgtttataaagcggatgactacgttcatgaaaaaccctggcagggtattggcgtaggcgcggcggtaggactggtgcttggactgctgctggcgcggcgctaaatccccccactgaacagaattgcaaccctccctaaatgaggtactgcttttttagggcagtaccccgtataatgtggggtttttaacagggaggggccgcgtgcattctattactactgcgctggaaaatctgacgcgtcagctatcgcaagagataccggcgacgccagggctttgcgttttcgatgcgcctttccctttaaacgatgccttcgatgcattgagctggctggccagccagtcatcctttccgcaattctactggcaacagcgcaatggcgacgaagaagctgccgttctcggggccatcaccgtcttttcatcgctcgatctggcgcaacggtttttacgtcagcacgcgcagcctgacctgcgtatttgggggctgaatgcgttcgagccgaaagagggctacttattgctgccgaggctggagtggcgacgtagcggtggtacggcgaccttacgcttacatctgcacagtgacgtttcgctacgcgatgatgcgcgcctggcgaaagcgtttctcgcttctctggtcggtattaagcctgttccggcgctgcgcctttcgctcacgagcgaacaacactggccggacaaagacggttgggtgaagctgattcagcaggccacccacactattgcgcaagaggcgtttgataaagttgtgctggcgcgggccaccgacttacaattctcccgtccggtcaatgccgccgcgatgatggcgtccagtcgtcgtttaaatctcaactgctaccacttttttatggccttttccgccgataccgcctttctgggatcatcgccggagcggctctggcggcgtcgtgaaacggcgctgcgtaccgaagcgctggccgggacggtggcgaaccatccggataaccataaagcctggcagcttggcgaatggttaatgaaagacgataaaaaccagcgagaaaatatgctggttgtcgaagacatctgccagcgactgcaaaactgcacccactcgctggatgtgctgccgccgcaggtgctcagactgcgcaaggtacagcatttgcgccgctgtatctggacggcgcttaatcaggcggacgacacgctctgcctgcaccagttacagcctaccgcagcggtcgccgggatccctcgtgaacccgcgcgttgttttatagaacaacatgagccgttcgaacgtgaatggtatgccgggtcggcaggctatctctccacgcggcaaagtgagttttgcgtgacgttacgttcagccaaagtgacggccaatgtggtgcggttgtatgccggcgcgggaatcgtccgcggctccgatccggaacaggaatggcaggaaatagataataaagcggccgggttacgtaccttattgcagatggacgcgtaatgagtcacatattcccgacccatatcaataatccatttttgcagctctttatacttagtcccaatgattgataccggacaaactcatgtcagtaagtgcatttaaccggcgctgggcggcggtcatcctggaagccttaacccgtcatggcgtcaggcatgtttgtatcgctcctggttcccgttccacgccgctcacgttggcggcggcagagaatcctgcttttattcaccatacgcactttgatgagcgtgggcttggtcatttggcgttagggctggcgaaagtcagccaacagccggttgccgttattgtcacttcaggtaccgccgtggcgaacctctatccggcgctgattgaggcgggtctgacgggcgagaagctcattttacttaccgccgatcgcccgccggagttgattgactgcggcgccaaccaggcgatccgtcaggcggggatgtttgcctcgcacccctcccaaactctgtcgttgccgcgtcccacgcaggatattccggcgcgctggctggtgtcgaccatcgacaatgcgctcgccatgcttcatgcgggcgcgctgcacattaactgtccttttgccgaaccgctgtatggcgatatgaatgacaccggtctggtctggcagcagcgtctcggcgactggtggcaggatgaaaaaccctggctgcgcgaagcgcgtcgactggcaagcgacaaacagcgcgactggttcttctggcgacaaaaacgcggtgtcgttgtcgccgggcgtatgagcgcggaagaaggcaaaaaagtggcgcagtgggcgcaaactctgggatggccattaattggcgacgtattgtcgcaaaccgggcagccgctgccgtgcgccgacctgtggctcggcaacgccaaagcggtgaccgaactgcagcaggcgcagattgtcgtccagcttggcagtagccttaccggaaaacgcttactgcaatggcaggcaacctgcgtgccggaagagtactgggtaatcgacaatattgaaggtcgtctggacccggcgcaccatcgtggacgcagactggtagcgaaaatcgccgattggctggaactgcatccggcggaaaaacgtaaaccgtggtgtgtagagatcccgcgtctggcggaactggcgtggcaacgggtggtcgcgcagcgagacacctttggcgaagcgcagctggcgcaccgtatccgcgactatctgccggagcaggggcaattgttcgtgggcaatagtctggtggtgcgtctgatcgacgcgctgtcacagttgccggccggctatccggtatacagcaatcgcggggcgagcggcattgacggcctgcttttcacagcggcgggcgtgcagcgcgccagcgccaaatcgacgttggctatcgtcggtgatttatccgcgctgtacgatcttaacgcgctggcgttactacgtcaggtatccgcgccgtttgtgttgattgtggtcaacaataacggcgggcagatcttttccctgctgccgacgccgcaaagtaagcgtgagcgcttttatctgatgccgcaaaacgtccattttgaccatgcggccgccatgtttaacctgcgctatcatcgcccggaaaactgggaagaactggagtctgcgctggctggcgcgtggcgaaccccggcgacaacggtgattgagctggtggtaaacgatacggatggcgcgcagacgctgcagcaacttttggctcaggtaagccatctatgatgttgcacgcgcagcacatgcccggacagcctgggacgccctcgctggttttcctgcacggtttttctggcgattgccgcgaatggcagccggttggcgaacagtttcacggctgttcgcggctttatattgacttaccaggacatggcggatctgcggctattccggtcggcggctttgccgatgtcatcagattactgcgcgccacgttaattagttacaacatactaaagttttggttggtgggatactcccttggcggccgtgtggcgatgatggcagcctgccagggaatacccggcctgtgcggcctggtggtcgaaggcggtcatccggggctgcaaaatgaacaggcgcgcgctgaaagacgattgtccgacgggcgctgggcagagcgttttcgtcatgaacccttgactgaggtttttcacgactggtatcagcagccggtgttcgcctcgctgacggcgcagcaaaggcaggcgctaacggcgctgcgtagccagaataacggcgaaacgctggctgcgatgctggaggcgacatcgcttgccgtccagccggatttacgcgaggtgcttaacgcgctggcatttccgttttattatttatgtggcgaacgcgacagcaaattccgcgccctggcgcaggaagtggcggcgacatgccatgtcattcgtaacgccggacacaacgcgcaccgggaaaaccccgctggcgtggtagacagtctggctcagattctgcgtctctgactaaaggacacactatgatctatcctgatgaaacaatgctttacgcaccggtagaatggcacgactgctcggagggttacaccgacattcgttatgaaaaatccaccgacggtattgcaaaaatcaccattaatcgtccgcaggtgcgcaatgcatttcgtccgttgaccgtcaaagagatgattcaggcgctggcggatgcccgttacgacgacaacgtgggcgtgattattctgaccggcgaaggcgataaagcgttttgcgcgggcggcgaccagaaggtgcgcggcgattacggcggttatcaggatgactccggcgtgcatcacctgaatgtgctggacttccagcgccagattcgcacctgtccaaaaccggttgtcgcgatggtcgcgggttactccatcggcggtggtcatgtgctgcacatgatgtgcgacctgaccatcgcggccgaaaacgccatcttcggccagaccggtccgaaagtcggctcctttgacggcggctggggcgcttcgtatatggcgcgtatcgttggtcagaagaaagcgcgtgaaatctggttcctgtgccgccagtacgatgcgcaacaggcgctggatatggggctggttaacaccgtcgttccgctggcggatctggaaaaagagaccgtgcgctggtgccgcgaaatgttgcaaaacagtccgatggcgctgcgttgcctgaaagcggcgctgaatgctgattgtgacggtcaggccgggctgcaggagctggccggcaacgctaccatgctgttctacatgacggaagaagggcaggaaggccgtaacgcctttaaccagaagcgtcagcctgatttcagcaaattcaaacggaacccataatgcgtagcgcgcaggtataccgctggcagatccccatggacgcgggggtggttctgcgcgacaggcggttaaaaactcgcgacgggctgtatgtttgtctgcgtgacggcgagcgtgaagggtggggagagatctccccgctgccgggcttcagtcaggaaacgtgggaagaggcgcagacggcgctcctgacatgggtgaatgactggcttcaggggagcgagggattaccggagatgccttcggtcgcgtttggcgcaagctgcgcgctggcggaactgactggcgtcttgccggaggcggcggactatcgcgccgcgccgttatgcactggcgatcctgacgatttggtactgcggcttgccgatatgcccggcgagaaaatcgctaaggtcaaagtgggtctctatgaagcggtacgcgacggcatggtggttaatttgctgctggaggcgatcccggatctgcatctgcgtctggatgcgaatcgcgcctggacgccgctaaaagcccaacagttcgcaaagtatgttaatccggattaccgcgctcgtatcgcctttctcgaagaaccgtgtaagacgcgggatgattcccgcgcctttgcccgtgaaaccggcatcgcgattgcctgggacgaaagtctgcgcgaagcggatttcacctttgaagccgaagagggcgtcagggctgtggttatcaaacctacgctgaccggatcgcttgataaagtgcgtgagcaagtcgctgccgcccatgcgttgggactgacggcggtcatcagctcttcgatcgagtccagcctcggcctgacgcaactggcgcggattgccgcctggttgacgccgggaacgctgcccggactggataccttgcatctgatgcaggcgcaacaggttcgcccctggcctggtaacgcgttgccttgtctgaagcgtgatgagctggaacgactgttatgacattcacggactggccgtggcgccactggcgtcaggttcgcagtcaggcgcccgctctgcgcctgaacgatgaagtgctaagctggcgcgccctctgtgagcgtattgatgcgctggcgggcgggtttgccgcgcagggcgtacgggagggcgacggtgtcctgctgcgcgccgggaatcagccgcgcactctgttggcatggcttgcgctgatgcagtgcggcgcgcgggttctgcccgtcaacccgcagttgccccagacgttgctggaggcgctggtgccgaagttaacgctgcgttttgcgctgacactggaaggcgaaaacgcgttttccggattaaccgtgttgcagttgcggaaaagtacagtggcgtatgctgtggcctggcaaccgcagcgtctggtttccatgacgctgacatcgggttccacaggattgccaaaagcggctgtacatacgtgccaggcgcatcttgccagcgcgcagggggtgctttcgctaatgccgtttggccctcaggatgactggctgctatcgctgccgctgtttcatgtatccgggcagggtattatgtggcgttggctcttcgccggggcgcgcatgacggtacgcgataagcaaccgctggagcagatgctggcaggttgtactcatgcttcgttggtgccgacgcagctgtggcggctgttggcgaatcgggcggcggtgacgctgaaagccgttttgctcggcggcgcggtgattccggttgaactcaccgaccaggccagcaaacaagggattcgctgctggtgcgggtatgggctcacggagttcgcgtctacggtatgcgccaaagaggccgatggttcggatgatgtgggcgcgccgctttccggcagagagatcagaatcgtcgataatgaagtctggctgcgcgccgccagtatggcggaaggttactggcgtgatggcaaactgatcccgctggttaatgacgaaggctggtttgccacgcgcgatcgcggcgagctgaaccacggtaggctaaccatcgccgggcggctggacaacttgttctttagcggcggcgaaggcattcagccggaggaagtcgaacgcgttattaacgcgcatccgctggtgcaacaagcctttgtcgtgccggtagaagataaagagtttggccatcgtcccgttgcggttgtggagtatgcatcgcaggccggagacgtgaacctcgctgaatgggttcgcgataagctggcgcgttttcaacagccggttcgctggttgacgctgccgtcagaactgaaaaacggagggattaaaatatctcgccgtgcgctccagcagtgggtgtgtaagatctgtaaaaattaatgttaggttaatatacaaccattccatcgctattgccgttttgtttatccgttgatgtgtaacgtgttatgaacaatcagcgtgaaacgggggcgctatggaatggttggttaagaaatcgcattatgtcaaaaagagggcgtgccatgttctggtgctgtgcgatagcggcggttcgctaaaaatgatcgccgaggcgaattccatgatattactgagtcccggcgatatcctgtcgcctttacaggatgcgcagtattgtattaatcgggaaaaacaccagaccttaaaaatcgttgatgcacgctgttattcctgcgacgaatggcagcggttgacgcgcaagccattatgatctggcgggcagaaaaatcagcattacccccgccataatgcacaatacgccgagcatcgcttttaggctgaaagcgccttgcaaaccgggtaacaacattgaggctacccagacaagcacataactgagactcagcagcgcataggctttgctgagcgcgagcatgtgtaatgttttctgccagcagaagacggaaaccagatatcccgccaaaccggcgaatagcgccagggtcgcggcattaaatgcgcccagcccggaaataaacgccagtggatgcgctatcgatggcagtcgcatcatggcgaatcctaaactcaactgggcgagggaggcaatcgcaacgcttatcagtccccacattacgcccattatgccgcactccccagaatgataatgccgctgataattaatgcgacgcccaaccagtggcggggcagaacctgttcatgccagattttccaggccgccagcgtgacccagacaaaattcagattcaacatcgggtaagcaattcccaccggcagggtttgtagcaccagcagccacagcaccatcgctgcacccatgcatatcagcgccaggcccagccacagcatcaagtgacggcggcgtccgctcgtcgtcaatggccgtgtcgcttgcttctggcagagctgaccgtcaacgctgagcagactggcaagcaccagaacgatgccgatcatttaggccgatactgaattaacaccagacgcccctgataatcaacattgtccgcagggggaagggaaagtgcgctgatgtcttcgtctttgtctattgaaagtactagcgtaataatgccctcctgacgatgttggttgagccaggcgttaaaatcgtcggctttaacgaatttattctgtacatcaggatagctaagaccatacctgagttcgcccgcgtgtccgtagagcataatatcgtctcgtttcagactccaggccagcccggcggcgacgcccacgctgtcggcaagaatatagcggcttgatgccaaaggcgcctgggtcatttcgacaaaaaactgtggctgtttggactccatcaccctgtcggggacggaaaagccgaacagcagcgccagtcccagcggacaaaacgcgggtaataggtattttgggctatgacagaggctataccagcccacaaacgcccaaacagtaaagacgccccagacgcaaaacactttataggtttcgatatgcgtccacaccggcgatttcagcgggccccatgaggagacgacaaacgccgcgacgatcccgattatcccgaacaccaggttgatcccgccgttgacacgtagcgcggcgacgccttcttttacgttatgcaggacgaagcgcgccatgagtatcgctatcggtgcgaaacaggaaagaacataggtgggcagtttccctttcgcaatgctgaaaaagagaagcggcatgatcgtccatccgagcaaatagaatgcgccgtttcgctcgcgccagcccagtttaagcgcgccaggcagtaaccccagccacggtaaacttcccgcgagcagcaccggcagatagtaccagaaaggggctttatgctgggcatcgctcatggcgaatcgctggatatgctccacccagaaaaagtaatgccagaaatcggcttcgcgtcgcgcaatggcgatcgcccagggaaggacaaccacaaagcagctcaagaccgccagccagccgtaaagcaaaaagtccttccagcgtttctgaacaataacccacggcagcacgctcaccaccggtacggccagggcgaggaaccctttagttaatacacccagaccgcaggttgcgcccagtagcaaaaacatcccaatcttgcccgttcgggtcgtggcctgcatcccctgccagaaacaacacatcccggccgtaagccaaagcgcgatcatcgggtcgagtaccgcatacgtcccgatactgtaaacggcaaagagggagagaaagatcacggaggcgagcaacgcggtacgtttatcccgccataagcggaacgtcagccacgccaccagcgctgcggccagcaatgtcgttaaaatagcgccggcccgcacgccaaaattggtagcgccaaaaagccactgacccagactgtttatccagtaaccggctatcggtttttcaaaataacgtaatcccagaaaatgcggcacgatccagtcgccagacgccagcatctcccgacttatttcggcatagcgcgtttcatccggctgccagagcaggcggctgttgacaggaataacatagtagagcgcgataaacgcggcgaaagccagataatagcgtatcgatttcatcatgaggcgctcactgcctgttgacaccccagccaaccttcacggccagggatgtgtccacgtacaatttgccccaacggcagagactcaggcgatgccggcagcagttcgcccagaggacaaaaggtgatccccgcatcgcgtgcacgaacgagcaaatcttcaaacagcggctgatggacaataccttcgacttccgcatggatggtatataccggcgtgcctttgtcctgcaacatacgggaaataatccaggtattgaacgactgcgcctgaacggcggggccgataacctcatcccacgtgggtaaggtgaccgggatttgcggcgtccctgtctggcccggcatcagtagcggacggaataaggtggttccacggcaatcgctgttatacctcaggttgaacggttctttcgcacgaacaacgcgcccatccgctcgccagccggccgcggctgagcaggtgacgggttttccgataatggcttcaagcgccgttatgccgcgcgcaatatcttcttcaagctggcggatactccagtggccgctgtgagtctgccacgcatggtgatcccaggcatgtagtcccgtctcatggtatgttgccgtttcacgaataatcccggcattagcgttgccgatattttttcccggccaggcggtgccggccagcaggatatcccaaccgtagagcgaggcggcgtttgaacgtagcattttccataaaaatcgcggttttatcagacgccaaagatggcgtcccatattgtccggcccgacgctgaagaaaaagctggcctgaacgccgtggcgatgcaatgtcgccagcagccggggaacaccttcacgcgttcctcgcaaggtatcaacgtcaatgcgtaaaccgactttcgtcatgatgcgcgttccgcgatatcgacgctacgcagaaagaagtccagcgttttttcaaccgtatcacgcatcgcaatagacggctcccagtccagacagcgcctggcattgtcgatactgggtttccggtgtgcgacatcctgataacccttgccgtaataactacggctttcgacgacctggaaaccggcaaatggtgggaaatggcagcgcagcggatgcttatcaaaactgtcgagcaacagcgtcgccagttcctgaatactggcttcgttgtcagggttgccgatattaatgattttgccatcgcaccgatcgccctcattcacaataatgcggaataatgcttcgatcccgtcacgaatatcggtgaaacagcgcttctgctgaccgccgtcgataagcttgatcggcgtcccttctaccaggttcagaatcaactgcgttatcgcgcgtgaactgccgatacgcgccgcgttcaggctatccagccgcggccccatccagttaaagggacggaaaagcgtgaagcgcaatccctctttttcgccataagcccaaatcacccggtcgagaagctgtttggaaacggagtaaatccagcgcggcttattcatcggcccgacgatcagattcgatttgtcttcgtcaaaagaggcgtccgtacacatgccgtacacttcagaggtagacgggaaaaccacgcgtttacggtatttcacgcaataacggataatccgcaggttttcttcaaaatcaagttcaaagacgcgcagcgggttgcgggtgtattcaatcggggttgcaattgctaccagcggcagtacgacatcgcattttttgacatgatattcgatccattctgagtggatgctgatatctccctccacgaaatgaaagcgagggtggagcaggaatcggctaatggcgttgctgccgatatccataccgtagacctcgtaattctcttcatccagtaaccgttcggtcaaatgattgccgataaaaccgttgacgccgaggatgagaacgcgaatgcgacgtttaccgctggtcgctggtggacggttcaaacacgcgcccgccaccagaccaagcgtctgtgcaagctgcgagccctgtacagtaatgccgtctccggcctggccggtaataatctccagcgcgccatcggcgcaggcgacccgcagcggagagaccgaaattaccgagccgggaagcgcgccttgcgcatccggacaaattcgggaagaccagatagtgaatttttgcgagccgttatagctgaacgcgccgggccagggggcggctaccgcccgcaccaggttatgcaccgtggaaaccggtttgtgccagtcgataaggccatcttccggcctgcggcgaccataatacgtagcgtcagactcacgctgaggaacagaaggtatattgccgcatttcatggtgggcaggatgctattaagtaactggcgcgcggcctgacatagcttatgatgcagggtaagcgcaacatcgtcctgcgcaatagcgacgcgttgactggcgacaatctctccggcgtcggcacgtttgaccatacgatgcagcgttacgcccgtttcgctttcgccgttaaccagaacccagtttagcggcgcacggccacgataggctggcaatagagaaccgtgcagattgaacgcgccagccggggcgaggtgcagaatttcttcgcttaacaggttgcggtaatagaacgaaaaaataatatctggcgcaagttcagcgatgcggtcgacccagataggatggtttacgttatccggcgcataaaccggaatccctaatcctgccgccagccgggagacggagccaaaaaaggtgttttccgcaagattgtcggcatgagtgaaaattgcggcaatctcatatcctgcatccagtacggcctgcacgccctgacatcccatatcgtgataggcaaaaataacggctttcattggtgactttcctcagtaaacgacgtgctttccgggtagataacttgttgaacaaaatagcgggggcgggcgcggacatcgttataaatgcgaccgatgtattcgcccagcagtcccataccgatgaattgcgcgccgatgaaggtaaacagaacggcaaagagcataaatacgccttccgccgcccactgcggtcccagtgccaggcgaagtacaataagcaataccgacaggctaaacccgccgatggcgataacactgcccagcagactcaacaggcgcagaggcgtcgtcgtcaggcaggtcaccaggtcatacatcaggttaatgagacgcataaaactgtatttagagtcgccaaattcacgttcagcgtgatgcaccgggatttcggtagcccgacgagcgaaaatgttggccagaatagggataaaggtgctgcgttcatggcagcgcaacatggtatcgataatagggcggcgataggcgcgtaacatgcagccgtaatcgcccatcgctttgcccgttgtgcgctggatcagcagattaatgatttttgacgccgatttgcgaaacaggctgtcctgtcggttctgtcgcacggtgcctaccacatcgaatccttcatcggctttcgccaccaggcgcgggatctcttccggcgggttttgcagatcggcatccagcgtaatgatgagatcgccgcttacatggctaaaccccgccataatcgctgcatgttgaccgtagttacggttgagtaaaatagagatgatatggctatcggcctcctgggacgccttaaccatcagctccgccgagctatcgctgctaccatcatctatcaataaaatctcccacgctttgcccagactctcgcaggcggtggtggtgcgtcttatcaattccggcaggctttcctgttcgttatagacaggaataaccaccgagactttttttatgggggcggcgtcaaacatgcttattgtcctgctatctgatgaagggcggtaatgacccgatcaaagtcactctcggtcatgtccgggaagagcggcagtgagcagatccgctcgctgttccactcggtgtcaggcagcgtgagcgttgggaaacgttcgcgataatatttttgcgtatgcgcggcgcggaaatgcagccctgtgccgatgcctttcgttttcagcgatgccatcagagcatcccgggtaataccgcagcgggcttcatcgacccggataatgaataaatgccaggcgtgaatatgctcccacggcggaaggctcagaggctgaaaaggaaggtctgccattgcctgatggtactgcgctgcgatggcggcgcggcgagcgttaagcgcatccagtttctgtaactgggcaagcgcgatagcggcgttgaagtcgggcaaattatatttgtagcccggcgccaggacttccgcttgtggcgcgcgtcctccgctctgtcgatcccaggcatcaacgccaagcccgtgaaacttgagactgcgcagtttatcggcgaattgcgggttatccgtgacgacgataccgccttcagcgcaggtaatgttcttaatggcgtggaaggagaaaatcgcggtgccccgggcgccaatgtggcgacctttgtagctggttcctgtcgcgtgcgccgcgtcttcaatcaccggaatgccataacgcgcgccaagagcgtaaatagcgtccagatcggcgggcgcgccagcgtagtggacggggataattgctttggtttgtggcgtaatcgcggcttcgatatgttcaggcgtgaccatcagcgtatcgcgatcgacatcgaccatgacgggggtcgcgccgagtaaaacgatcatatttagcgtagaaacccacgtcattgacggtgtaatgacctcgtcgccttcaccaatacccagcgccatcaacgcgatgtgcataccggcagtggctgaactgacggcaacggcatattgattgcctgttagccgacaaaacgccgcttccagttcctgatttttcgggccggttgttatccaacctgagtccagtacggtcttaacggcagcgagctcttccgcgcccatcgccggacgggagaaaggcaaaaagtccgacatcatttttccttcagccattgaaagccgcttttcaaatatttcggcaatagaaaagggcttattttttaacgcatttagctgaaccctactggatgaagattaaattaacattaagaaattaaggtgaagtaaaaagataattttaacggaattatgctttgctttcgccgaaagtttaaggcattttatgcatgcccaaaagctgtttttatgtttctggtcttccgtcgcggaatttcattttaatcgtattgctattaagttagctgcactgtctgcctgagaggttaatgtgctggcatttaccctacgctttattaaaaacaaacgctatttcgcgattctggcgggggcgttggttattatcgctgggttggcctcacaacatgcctggagcggtaacggtctaccgcagattaacggtaaggcgctggcggcgctggcgaagcagcatccggtagtcgtgttattccgccatgccgagcggtgcgatcgttccgataatacctgcctgtcagacagcacggggattacggtcaacggtgcgcaagatgccagagcgctgggtaaagccttcagtgccgatatacaaaattacaatctctattccagtaatacggtgcgcaccatccagtcggcaacctggttttccgcaggcaggtcgcttacggcggataaaaaaatgatggattgcggcagcggtatttatgcttcaatcaatacgttactgaaaaagtcgcagaataaaaatatagtcatttttacccataatcattgtttgacgtatattgcaaaaaataagcgcggcgtgaagtttgatccggactatcttaatgcgctcgttatgtatgcggaaaacggaaaactctttttagacggtgaatttgttcccggctagccgcatgttaaaagcgtaaagacagcctgaagcggctgtcgttattataataaccctttcaatgctaatgtgtggcgtgtcgctacattcaaatcatacagcgccagttcttctggcttgacccaggcgtagtcctgaaattcgtcgttaatacatatatcgcggttagcggaaacacagtcgaagatgagataaatcatataaatctcttcttgtctgccatcagcgtacgttttaacgcggatatcgtcgcgaaaggtccacggcgtaatatcgctcagaatcagttgttcgccgagttcctcccgaatctcccgacgcagcgcctcttcaatacgttcgcctggctcgaccccgccgcccgacagcgcccactgaccgggaaagacgccgcggttgtcggccattttgcacagcagataacagccatcattttgaattaatgggcaaactatagttcgttgacgcataagtcgcttccttaaaccaccaggccatcagcttaacaaatcattctgcgaaattctttgtgaaaaatggaagcgataacgcagactgcgttttttgttaattttgttgatgcaggcgtcgccatgtgatggcgcaatgatgcgtcacggcgaaagtagtatttcgttacaatatgtttttggaatggtttcttagtgcattgattcctcagcgtctggcagtacaattctgccgttttggggagtttttctttatgtgcttgctggaaagggtaaaaatgaaaaaaagcatattattaggttttgccggaatgctgttcgtttctgcatcggcgcaggccatcagtattagcggccaggcgggcgaagattacaccaacattggcgtgggttttggtacggaatcgacgggactggcgctaagcggcaactggatgcacaacgatgatgatggcgacgctgcgggcgtgggtctggggctgaacattccggtgggaccgctgctggcgacggtaggcggtaaaggtatttataccaatccgaaagacagcgatgaaggctatgcggcggctgtcggcggtgggttacaatggaaaatcggcaacagcttccgtctgttcggcgagtattattattcaccagattcgctgtccagcggtatcgaaagttatgaagaagcgaatgcaggcgcgcgtttcaccattatgcgcccgctgagcattgaagccggttatcgttacctgaacctggcgggtaaagacggcaaccgcgacaatgcgattgctgacggcccttatgttggcgtaaacgccagtttttgatgctaacggcgcggcaatcgtcgcgccatattcctccttttcccgtcattcttctttccacgtcatattcgtctttgcgttatagtgttttcatcataaaagcaggagaacacaatgctaaatgtggaaatgctatccaccggggatgaggtgttgcacggacaaatcgttgacaccaatgccgcctggctggctgattttttctttcatcagggcgttccgttatcacggcgaaatacggtaggcgataatctggacagtctggtcgctatcttgcgtgaacgcagtcaacatgctgatgttttgattgttaatggcgggttagggccgaccagcgatgatttaagcgcgctcgccgcggcaacggcaaaaggcgaaggattagtactgcaccaggcgtggctgaccgaaatggaacgttactttcagcagcgtggtcgcgtgatggcgccgagcaaccgtaaacaggcggaactgcctgccagcgcggagtttattaataatccggtcggcactgcctgtggatttgcgctacagctcaaccgctgcctgatgtttttcacccccggcgtaccgtcggaatttaaggttatggtggagaaggaaatcttaccgcggttacgcgcgcgtttttcgctgccggagccgccgctttgcctgcggttaacgacttttggacgttcagaaagtgacctcgcgcagcgtctcgattcactgccgttgccgcccggcgtgacgatggggtatcgctcatcaatgccgatcattgaactgaaattgaccggcccggcgacgcaacgggaggcgatgctggcgttatggccagaggtcaaacgggtcgccggacagaacctgatttttgaaggtacggaaaatctgccggcgcaaatagcccgccgcctgcaggaaaggcagttgagtctgacgttgagcgagcaatacaccagcggtttactggcgctacagctttcccgtgccggggcgccggttcttgccagcgaagtcgttccttctcaggaagagacgctggcgcaaacggcacactggacgacagaacggcgcagcaatcattatgccggtctggcgctggccgtgtcggggctggaaaacgaacatcttaatttcgcgctggcgacgccggatggcacgtatgccttacgcgtgcgttttagcgccaatcggtatagtctggcaatacgtcaggaggtctgcgcgatgatggcgctaaatatgctgcgccgttggcttaatggcgaggacattaccagcgagcatggctggatagacgtggttgaatcattgacattataatccctttctcttatctgcgatgggaacgacatcgtgagccggataaggccgctatgccattatccggcaatattatctgcttttttgtccagccaattgtactgaatacaaagtaatacgtgcgttaattcacatttatatggttaacccttccactccgttggaaggcggataagctttgacgcgcttcacaattttttccctactgacctttcacactgattccagtgtctcagactggagtccaatatgttggaatcaagtaaagtcccggctcttactcgcgcaatcgacatcctcaatttgatcgcgcgtattggcccatgcagcgcggcaatcattattgaaacgttgcgtattccaaaaagcaccgcgtacctgctgttgaatgaattaaaacgtcagcgatttattagcctcgatcatcaggagaactactgcctgtggactaagctcgttgaattgtcgggtcatgcgctcagcaagatggatctgagggagctggcgcgtcctcgtctaacacaactgatggatgaaatcgggctgctgtgtcacttggggatcatcgaccacgaaaatgcgtattacatactgaaagtggaatcctcatccactatcagcgtgcgctcgcatgaggggaaaagcctctctctttatcgttccggcatcggcaaatgcctgctggcatggcagccggccgccgtacgcaaagccattattgaaaaaatggtatgggagcgagccacgctgaccaccatcaccgagccgcaacaattgaatgatgagctggaacgcattcgccagcgtggatggagctttgataacggggaggattatccggatgtccgctgcgttgccgcaccggtatttaatgccagaaacgaactgaccgcggcaatttcactggtcggcacgcgcctgcaaatcaacgaagagaatcttgattatttggccggtaaagctattgcctgtgccaaagatatttcacgcctgttgggatggaaaagtcccttcgactcactcgcatcttaaaatggagaatattatgactcttcctaaaattaaacacgttcgagcctggtttattgggggcgctaccgcagagaaaggggctggcggcggggattatcacgaccagggaggaaatcactggattgatgaccatatcgccactcccatgagcaaatatcgcgactatgagcagtctcgtcagtcttttgggatcaacgtgttagggacgctgattgtcgaagtagaggcggaaaatgggcagacggggttcgccgtttcgacagcaggggagatgggctgttttatcgtagaaaaacatcttaaccggtttattgaaggcaaatgcgtaagcgatatcaaacttattcacgatcagatgctcggcgcgaccatgtactactccggttccggcggtctggtgatgaacacgatttcctgtgtggatctggcgctgtgggatctgtttggcaaggtggttgggctgccggtttataaattgctgggcggagcggtacgcgatgaaattcagttttacgccaccggcgcacgcccggatctggctaaagaaatgggctttatcggcggtaaaatgccgactcactggggaccgcacgatggtgatgcggggatccgtaaagatgccgcgatggtggcggatatgcgtgaaaagtgcgggccggatttctggctgatgctcgactgctggatgagtcaggatgtgaactatgcgactaaactggctcacgcctgtgcgccatttaatctcaaatggattgaagagtgtctgccgccgcagcagtatgaaggctatcgcgaattaaaacgcaacgcgcctgcagggatgatggttaccagcggcgaacaccatggtacgctgcaatccttccgcactctggcagaaaccggcattgatattatgcagccggatgttggctggtgcggcggattaaccacgctggttgagatcgccgcgcttgccaaatcgcgcgggcaactggtggtgccgcacggttcgtctgtctattcgcaccatgcagttattactttcactaatacccctttcagcgagttcctgatgaccagcccggactgctccaccctgcgtccgcaatttgacccgattctcctggatgagccggtgccggtgaatggacgcatccataaatcagtgctggataagccgggcttcggcgtcgagcttaaccgtgactgtcacttgaaacgcccttatagccactaataactcgtgcgttgcctttgtacggcaacgccctcatcctgttgaggatattgctatgagcatcactttacttgacggcgtagtgaagaaaaaccgcgcacgtttaattccttttatgttggcgctgtacgtactggcgtttctggatcgttcaaatattggttttgccaaagagacctatcagatagataccgggctaagtaatgaagcctacgcgctaggggccggtattttctttgtggtttacgctttccttggcgtaccggctaacctgctgatgcgcaaatttggcgcaagaacctggatcggcacgactaccctgctgtggggctttctctctgctgcgatggcctgggcggatagtgaagcaaaatttctgataatccgcacgctattgggcgcggcggaggctggatttttccccggcatgatctatctaacttcacaatggttcccgcagcgtaaccgtgccagcattatggggctattttatatgggcgcgccgctggcgttaacgttgggttcgccgctctccggcgctctgctggagatgcatggttttatggggcacccgggatggttctggatgttcgttatcgaaggcctactggcgattggcgcagggatattcacctttttctggcttgatgacactccgcagcaggcgcgttttcttagcctggaagaaaagaacgcgcttatcaggcaactggcgagcgaagaagagaaaaaggtcacgtcaaggcttgcggatgcgctgcgtaatggacgcgtctggcaactggctattatttatctgacgattcaggtggcggtatacggactcatctttttcctgccgacccaggttgccgcgctattgggcactaaagtgggctttaccgcttcggtggtaacagcggttccctgggtggcggctttgcttggcacatggcttattcctcgctactccgaccgtaccggcgatcgccgtaacgttgcggcagtgacgctactggctgcgggcattggcattggcctgtcaggtctggtttctccggtgctcgctattctggcgctctgtgttgcagcagtaggatttattgccgttcagcccgtattctggaccatgccaacgcagctactttccggtacggctctggcggcaggaattggtttcgttaatctgtttggcgctgtgggcggttttattgccccaattctgcgcgtaaaagcggaaacgttgtttgccagcgatgcggcgggcctgctgacgctggccggagtcgccatcattggctcattaattatcttcacgctgagcgttaatcgtccggtggcgcaatccggcgctgcgcatcattaatcttatctacgttgtaaggatcgctatgaacgcattgttatcaaatccttttaaagaaggattacgtaaaagggatacgcaaattggtttgtggctcagttcaaccacctcttatatggcggagattgcggcgacgtcgggttatgactggttgttaatagatggcgagcacgcgcctaatacggtgcaggacttgtatcatcagttacaggccatcgccccatacgccagccagccggtgattcgcccgatcgagggaagtaaagcgctcattaaacaggtactggacatcggggcgcaaacgctactgatcccgatggttgacaccgcagaacaggcgcgccaggtcgtttccgctacccgatacccgccgttggggcaacgaggcgttggcgcgagcgtggcgcgtgcggcgcgctgggggagaatcgacaactatatggcacaggccaatgagtcgctctgcctgttggtgcaggttgaaagcaaagtggcgctggaaaaccttgacgcgattctggaggttgaaggcattgatggcgtctttatcggtccggcagatctctctgcttcattgggttaccccgataatgccggacacccggaagtgcagcgaatcattgaatcgtgtatttatcgtattcgcgccgccggaaaagcggcgggttttttggcggtcgatccggcaatggcgcagaaatgtctggcgtggggcgcgaattttgtcgcggtcggggtagatacgatgctctacaccgaggcgctggacagcaggttggcgatgtttaaatctgttcagtcagtaagcacggcaaaacgtagttattgagaaaaatgccggatggcacgtatgccttacgcgtacgttttagcgccaatcggtatagcctggcaatacgtcaggaggtctgcgcgatgatggcgctaaatatgctgcgccgctggcttaatggcgaggacattaccagcgagcatggctggatagacgtggttgaatcattgacggcatagaacttttagtgggaaggcttggccttcccatccttatatacttataaattcttggcagagcatcatttcaggataagtactcgccattactggagactgtattcatatatttgtcgccgggtttgggtgttaaatagtgtttgttcctctactgaaagcgttaagaaattttccgcaaattctcgtagtgtggtagcaggatcgttttgtcctgcattcgataagagttgaattgtatggtaacaaaatagaccacagccgttgggtacattattttgtaaattggtttcaataaaatcaatatcttcgttttctgatatgcctgcaatttttgctgcttctataatctcttgcttagtattttcatttaaatcatgataagtattaaatataaggcattttattttttctgcaagtttataaaataaacagataagccagtgatctcctgtatttatcagaaagacttcattttcagataatcctgattgagccatcttttcaagtagctgagtgcgtaatatattttctttggtggtaggatgaataagcccaataggatagtttaccgagagaagaggtgattcttgaaccagacctagcgttgcggctgctagctcatctgacgacaacattcgcgcactacaccaaagattttcaactcctacctgttcttgatctgtttgagcgaactggtcgcccataattttatgtgctattcctatttttttagaaaggtcggttgtcgcggaaccggccatataaagtaatctggaaggggcatgtagctttttccactcagtattatcttttgttatatcgttattggcgatttgatgtaatacaaggcaagcctgattgatttttttgtctatgtctggtgatcccgatctttttccgctaaagagatcaaaaagaaatttctcaactctatgtcccaggttatcattgcgtaacgcaagattgcataacagatcaatacaattctgatcaccgttctctacggcgctaaacaacaacgcaagcgcctcatcgctcacctcttctgaatataaactgtgaaattgcggtgtgctcaatcggtaaagtgaatttacacatatattcattttgctctgtttcctggtaggtgaaagtaacgaatatgatgtcatgtataattatttgtaaaaatattattgttagtgggagatatattaaatcaggcatagacctgattttattattattcacataacactcaattattattggagatattcagttatccccctctttaaaggaggctggtaacgcggcgatacaagagatattgctctataaacagtaacgtcgttatctgtcatgccaccgtgggttagcggtcatggttaaccaaatagggcaggttattgcaaagagacatccgcgtttatacccaaaataatccgtagccaacacataagcaacttgaagtatgaagggtatatgtctgatggaaaatcggccctggtgagtagagtaatggcgccggaggggctccggcgctttttacttagcccagcgctttcgccagtagcgtaatggggtattcgcagcgtttgcttgtagacatctcaatttgccacttacaggtttcacaatcggtgacgacaatgtcggcgccgctctcttcaatctggcggaacagcggcgcgccgatggactgtgatgtcggatagttttcctttttaaatccatacgtaccggcaatgccgcagcactgtgaatcaagtaccgtcaattcaagccccggaatttgtcgcaacagttcaagcgtgtaaagcgtccagcccattttttccatatgacacggcgtatggtagaccactttcagcggcaaaggattaagcggcagcgttttcccggcatccagtttgcgccatagccagcgggtggccagctcgatatgttcgcgcagcccggcgttgtccacgtccagcacttcaggatattcatcgcgcaacgcaaacgtacaggtggatgacgtggcgatgaccggaatacctttgacggcaatcgcctctcgtagcgactccacattgctgatagcctgtttgcgagctttatccgtaaaaccgttagcgatcagcggtacgccgcaacacttctctttactcagtaactgtacgccagtacccattgcgttcagcaccttaatcagatcttttccgagctgcggatggttgtaattcacaaaacagccatggaaaaaggcgacctgatctttgtatttagcctgctgcgccgccacgctacgataccagcggcggaaggtgccgaaagagtattttggtaaggtgcggcgatgatcgattttgagcgcgtaatcaagcaactggcgcactggctttaatgcggtggcggtattgaccaccggcgcgaacggcgttgaaacgctgcccatcagatcggtatggctgagaataaagttacgcaatgacgggcgcgtcgtatcgtatttcgcgcgggcgcgctggatgatatcgccaatcttcacgtccgacggacaggcgacctcacaccgtttgcagttaatgcaatatttcagcgcctcatcatacagcgcgccgtctttcagacgcaggcgttcgccatccggtccggcctgtttagggccagggtagccaggattaacgcggctgaccgggcacgcggtggtgcacaccgtacatttaatacaactttcaaaacgtgtgtcgctcattgctgttctcctgcacgctcagcgatatggtgcgcggcctggagggcgctgactgcgcagacgccgccgccgcatccctcagctataggatcgaatcccgccagcacagaacctattgcatacagattttctaccgtgttgcccgcaagggaggggcggaaagcgtcatccgtcacgacgccaaactgctgccagggctgtgggtcgaagaaatgttgttgataccattcggcgcgggtggccgtttgctgtacgtcgagccctaaaataggttcgcggatcccttcgcgctcggcaaccagcccgctactaaagaagctaccgctggcaagtacggcaaaacgcgggcgcagtgggatatcggcatggttgcgggtccatatttcgctcacggtaccgcgacggcaggtgactttcttcacttcatcgcccggcatccagatgccgccctgacggacaaactggcgctggagttgattgtgcagacgaataccgagcaccgatggcggcagcgtcggcagcagcgtgagcgcgcagggcagacgttcgttaagccagcgccacagcgtatcgttcgccagcccgaaacaggcgggcatgatgatcatgtcgcagtttgtcgctattggcgacagcgcgtcgtatagcagctgccatttttcttcgttatcaagcagacgcgcgatattgaccgcgcgaaattccgtcgggttatcacgcagtacgtccagttccggaaggtcgatttctgcggtttcaacgttgaggtcgcgttggcgcagcgacgctgccgcaaggtgcgcctggaaatccagtaatccgctaacgccgacgacgcaaattcgctgtgcggataacggccagaccggtacttccggcgagctaagccaggtagaacgcaatgtgccaagcggcgtgacacgctggtgcgcctgctgtacgtcgccgtataactgcgcgccgctggcgttaagtagcgtttgcgcctgttgcgccagcgtaaggactttttgcgcgcctaaacgcgaataaggatgttcaggcgcctggcggcgcagcgcatcaagcccggcggtaatgtcggtcaccggttggccgttgggcagggcgctaagtagatccagcgagccggaggaaaaatgcagcgcgctttgtccgcgggtgacgatggcgcagcgtaatccatgctgctggagttgcagtccgcatagcaaaccggcgagaccgccgcccataataaccgtatcaaatttcatcctggtgctccttctccagaccgcataatccctgataaacccagcgcgtgaattcgctttcgcgcagcgcgtctccccaggcgacaggttgtacgcctttccagcgctcattcagaaattcagagagttgcgtaatagattgcgccgcggtcgtcacattaaaacgctgcaatagcccggccgcgcggcaggcgcacagttcgccctggcaagtgcccatccctacgcgggtgcgacggcgcagatccagcaggctattcacggttaagttttcgacggcatactgcacttcccccgccgtgacggcctcgcattcacagaccaggctacggtgttggcggccttcactcagccaccccggcgtgcgatcgccatgccgataaaccgccgatccgcgtagcggcgcgggaagcgagataatgcgtttcagcgtatgttccgtagactcttttgagccaggcaacggcgtatccgccgtgatgcaggggcgagtattgcccaacttgcggcacacggcgtcggtcgcccattccgccatcaggcgataagtcattagcttcccgccggtaatggtaatgaagccatcaagcccgtcgcgttcggcgtggtcgaacaacacaataccgcggctgacgttacgaccgctgggatcgtcatcgctggccaccagcgggcggacgccggaatacgcgcgcagaatacgtgtcttcgccatgacaggggccagtttttccccttcacgcagcaggatatcgacttcatctgcggtgacgcggttgctgtctatctcattgtaatcaatatgggtagaggtggtgccgatcagtgaaatcgtatcgccaggtaccagaatgtcggcatccgatggtttccggcagcggttaatgacatgctggttgatccgatggtccatgatcaacagcgagcctttcgccgggaacatgcgaatactcaggtcggcgtattcggcgatccgttgcccccagataccagccgcattgaccaccaccggcgcgtgaagcgtctgggtttcgccagtgagatggttacgcacatggacgccgcagaccgttgcgccttcacgaatgagcccggtcacttcatgcgccgttaacacgattgcgccatgttctctggcatccagcatattggcggcggtcaggcggaaagggtctacggtgccatccggcacttttaccgcaccgatgagcgcagggttaacggaaggttcgatgatgcgagcctgctgcggatcgatggcttcagcgcgaatgcctgccgcttcacaggcgcgaataaaggtggcctgaaacgcaagaccatcttccggcaacgtaataaacagaccatccgtcggttcgacgcaatggcgggcgatccgttttaaaatctggttttcactaatgcactcgcgcgcggattccgcgtcggtaaccgcataacgagcgccgctgtgcagcagcccgtggttacgcccggtcgcgccggtcgctatatcatgccgctccaccagaatgacacgtaaaccgcgcagcgcgcagtcgcgggcgatccctgcgcctgttgctccaccgccaatgataatcacgtcacttgcttgcgagtcgcgagttttcattgtttttccttacagttcgttttttatcatttagccatacaaatcatatggaatgtttgatttcgcgcgcctttctgaacattagtcataaaactgtaacaatatgtgctgtaattcacattaacgtgacgtatctttacttaacatcgcggccacactgggagcagcggggttgtttgaacgaactgcggtgtttacctctaaataaaatacgggctacggaggctacaatatgttgagtatttttaaaccagcgcttcataaagcgcgcttgccagcggcggagattgatccgacctatcgccgattacgctggcagattttcctggggatattctttggctatgccgcgtattatctggtgcgcaagaactttgccctcgcgatgccctacctggtagaacagggtttttcacgcggcgatctgggctttgcgctgtccgggatttctatcgcttatggtttttcgaaatttataatgggttcggtgtccgatcgctcgaatccgcgcgtttttctgccggcagggttgattctggccgcagcagtcatgttgtttatgggctttgtgccgtgggcgacatccagcatcgccgtgatgtttgtgctgttgttcctttgcggctggttccaggggatggggtggccgtcgtgcggacgtacgatggttcactggtggtcgcagaaagagcgcggcggcattgtgtcggtctggaactgtgcgcataacgtcggcggcgggatcccgccactgctgttcctgctggggatggcgtggtttaacgactggaaagcggcgctctatatgccagcctttggcgcgattgtggtggcactgttcgctttcgcaatgatgcgcgatacgccgcaatcctgcggtctgccgcctatcgaagagtataaaaacgactatccggatgactacaacgaaaaagcggaagaagagctgactgcgaagcagatcttcatgcagtacgtactgccgaacaaattactgtggtatatcgctatcgccaacgtgttcgtctacctgctgcgctacggtatcctcgactggtcaccgacctacctgaaagaagtgaagcatttcgcactcgataaatcctcctgggcctacttcctctatgaatacgcgggtattccaggcacgctgctgtgtggctggatgtcggataaagtcttccgcggcaaccgtggcgcgtcgggcgtattctttatgaccctggtcactatcgcgaccatcgtttactggatgaacccggcaggcaacccgaacgttgatatggcttgtatgattatcatcggcttcctgatctacggcccggtaatgttgatcggtctgcacgcgctggagctggcgccgaaaaaagcggcgggtacggcggcgggctttaccggtctgtttggttacctgggcggttctgtcgctgcaagcgccattgtgggttataccgttgacttcttcggttgggatggcggctttatggtgatgattggcggtagcattctggcggtaatcctgctggtggtcgtgatgattggcgaaaaacgccatcatgatgagctgcagttaaaacgcaacggaggctaataacatgaaaaccacactgaaaaaccttagcgtggcgttgatgttggcaggaatgaccatcggaagcggcgccgtggcggctgaaaaagtcgtcatcgcccaccgtggcgccagcggttatctgccggagcatacgctaccggcgaaagcgatggcgtatgcgcaaggggcagattatctggaacaggatttagtgatgacaaaggacgaccatctggtcgtcctccatgaccactaccttgaccgggtgactgacgtcgctgatcgttttccggaccgggcgcgtaaagatgggcgctattacgctatcgattttacgctggatgaaattaaatccctgaagtttaccgaagggtttgatattgaaaacggcaaaaaagtacaaacttatccgggccgtttcccgatgggaaaatctgatttccgcattcatacctttgaagaggaaattgaattcgttcagggattaaatcactctaccggtaaaaatatcggtatttatccggaaattaaagcaccgtggttccatcatcaggaagggaaagatattgccgcgaaaacgctggaagtgctgaagaagtatggttacatcggcaagcaggacaatgtctatttgcagtgttttgatgtcgctgagctgaaacgtattaagaatgaactggaacccaaaatggggatggatctcaatctggttcaacttattgcgtataccgactggaatgaaacccagcagaaacagccggacggtcgttgggtaaattacaactacgactggatgtttaagccgggcgctatgaagcaggtggcggaatatgcggacggtattggtccggattaccacatgttggtcgcggaaggttcgacgaaagggaatatcaagctgactggaatggtgcaggacgcgcatcagaataagatggtagtgcatccttacactgtgcgtgccgatcaattgccggactatgccacagacgtcaatcagttatacgatatcctgtataacaaggcgggcgtcgacgggctgttcaccgacttcccggataaggcggtcatgtttctgcaaaaaaatgactaaaggtatgccatagtagaagtgaagcgccggatgaggacataaacgcctcatccggcctggcgcaacgtttgccagcgtaagtctgataaacgcaatgtcatcaggcggtgttgttttatagcaaaccctcatcggtcagtgtttccatacatttttgtaataaaaatagcgggcttccttctaccggcggttcttttgctaacagtgaaatttgtcgataaaaggtgggttccagcgccacggagcataattttcctgtcgtggcttttaaggttaattctggcaataaggcgatacctaatccctggcgaataaaattcagcgcagtatcgggatggttaaattcatatttaaatatcggttcaatacccttttctttaaacaacgccataatacttaattcataacgacctttactgacaataagtggttcgtccatcagttcttcgaccgttactgtactattggccgccaggggatgattttcaggcaccactacggtgaatttatcccggtaaatggggacgcaatacataccgttgaccggaaaaggaacgaaaccggcatcaatacttccgtcctgcagcgaatcaataatagccgtactgttctcttcataggggataatttttacatttggatgatggctttcaaaatagcgaatgacgccgggtaaaatgcaggcgcaggcgctgggaaaacagccaatccgtagcgtacgggccgggttctttttttcttgttcgacaatctcttttaccgcgttgacgtcgcgctggatcgcgcgtaagtgcctgacgatgcggctaccggcggcggtaagctcgatctctttacgacgctcacgaatcaatatgtcaacgccgagctcctcctcaagcgcggagatggcctggctgacggcggattgcgtcatgtatagccgtttgctggcctcggtaaatccgccgtactccagtacggcaagcagggcatggatttgggttagcgtcattagtaaaacctaatcaatataattaaaacgattaatttttctaataaagtgcacttgtttatactgcgattctatcgaatacatcacattttgacgcacctgataggtgttcagttgagctgagcgttgcctgcgtgcgccatctgaatgggtcgttaagaatgaaagaaaaattatggacgaaggatttttgggcaatcaccatagtaagttttattatcttttttgttttttatgtactgctaactttattacccatttatatcgctgaccgcctgcatgcttctgcagataaggcaggattgctagtgacatgtttcctggccgcggcaattgttattcggccgtttgccgggcagtgggtgggaaaatattcgaataaaaagattctggtgctctcttctttggcttttttggtgattaccgcgctgtatccagtttgccattctatcgagtcgctgctctttatccgcgtacttcatgggattacgtttggtgttattaccacggtaaaaggaactatttcagcgcggttaattccggcctcccgacgtggagagggcatcagctttttctctttagcgatgggcctggcgatggtcgtaggaccgtggattggtttgaatatggcccgctgggacgcgttcactgccgcattctggctttgttccgctgtagcggcgttagagattgtgctttccctgattgtgacggttcctccggtaattcgtcatgccgatggttcgaaaccgaatctgggtttttccgcgatgtttgaccgcgccgccttgccttttgcgctggtcaccttttttatgactttctcctatgccggcgtgtcggctttcctggcgctgtatgctcgtgagctggatttaatggcggcggccagtaatttcctgctgtgctacgcgattttactgatgatatgccgtaccttcaccgggaatatttgtgataaaaaagggccgaaatatgttgtttatccatgtctgttggcttttaccatcggtctggtggcgctgggctacaccaatggcagcatcatgatgattatttccggcggtctcatcggtatcggctacggttcggtcacgccggttttccagacgcaaattatcagctcggttgaaccgcataaaatcggtgtggcgaattcactgttctttaacgcgatggacgccggaatggcgattggcgcctttatcatgggaatgatggttgagtcggttggctatcgtatgatttatgtcgctggcgcggtgctggtggtactcgctggcgcactgtatgccgtgcagatgaaaaaacgtggcgtgatgccgttggtttccaccagcgagttgcactgagttacatctcgatttcgatatcgccttttgccctgcagcagcagggcaaaatctctcccggctggataaacgctaaaggttccgtaatccagtcaacctgaccggcaaccagccgggtacgacaggagccgcaatatccttcgcggcactgatactccacctcaacgttatgcgattccagcgcggccagcagagaagggtgttcatcctggcacagcagctgtgtgccagtgatacgcagcgtgacgcgtcccatcagagctggaaattactcagatcgtcggtatcgacttccgaatcgatttgtccgaccagataagaactaacttccacttcctgtggcgcaacctgaacgttatcggacaccagccaggtattgatccacgggattgggttggagcgggtctggaacggcagatccagacccactgcctgcatacgaatattcgtaatatattcaacgtattgacacaggatatctttattcaggccgatcatcgaaccgtcgcggaacagatagtccgcccactctttttcctgctgcgccgcctgcacgaacaggtcatagcattcctgtttacactcttcggcgatttccgccatctccgggtcgtccacgccgctacgcaacaggttcagcatatgttgcgtgccggtcagatgcagcgcttcgtcacgggcgatcagacggataattttggcgttgccttccatcagttcacgctcggcaaatgcgaaagagcaggcgaagctgacgtagaagcggatggcttccagcgcgttcacgctcatcaggcatagatacagttttttcttcagctcacgcagattcacgacaaccgttttgccattaacggtatgggtgccttcaccgagcagatgccagtaactggtcatctcaataagttcgtcgtagtaggcggagataccttcggcgcgcttctgaatttgctcattggtcacgatatcgtcaaacacgaccgccggatcgttgacgatgttacgaataatgtgggtgtaggatcgtgagtgaatcgtctcagaaaacgcccaggtctctacccacgtctccagctccgggatggaaatgagcggcagcagggcgacgttcgggctacgtccctgaatggaatccagcagcgtctggtatttgaggttgctgatgaagatatgtttttcgtgctccggcaacgcctgatagtcgatacgatcgcgggagacgtcgacctcttccggacgccagaagaaagagagctgtttttcgatcagtttttcgaagatgtcatatttctgctggtcatagcgtgcaacgttgaccggctggccaaagaacatgggttccttgagctgatcgtttttcgtttgtgaaaaagtggtgtatgccattgaagtgaatcctttatgggatgagcgccggatggcggcgcaaacgccttatccggcctacaaaccgtacaatcgtaggccgggtaagcatagcgctacccggcactattcatcagatcttacaagcgccgctttcgcagccatcgtcctgaatagaaggcgccaaatcgtcctgcgcatcttccgcgccgtcgcgggtattttgatagtacagagttttcacgccaaacttatacgcggtgagcaaatctttcagcagttgctgcatcggcacttttcctgacgggaaacgtgacggatcgtagttggtattagcggaaatcgactggtcgataaacttctgcatgatacccaccagttgcagataaccgtcgttgttcggcatctcccacaacagttcgtaagcgtctttcagatgctcataatccggcacgacctgacgcaaaataccgtctttcgaggccttgatgctgacgtagccgcgcggtggttcgataccgttggtggcgttggagatctgggatgacgtttccgacggcattagcgccgatagcgtggagttacgcagaccgtgggttttgatcgactcacgcagctgttcccagtcgtagtgcagcggttcgttgacgatcgcatccagatcttttttgtaggtgtcgatcggcaaaatgccttttgcataggtggtttcgttgaaccatgggcaggcgccttgctctttcgccagttcgttggacgctttaagcagatagtactgaatggcttcgaaggttttatgcgtcagattattggcgctgccgtcggaataacgtttaccgtttttcgccagccagtaggcgaagttaatcacgccaatgcccagcgtacgacggcccattgcgccgcgtttggcagccggaatcgggtaatcctgataatcgagcagagcatccaaagcgcgtactgccagaatagccagttcttccagctcgtccagagtcttaatggcacccaggttgaaggcagacagcgtacacaacgcaatttcgccgttttcatcgttgacatcgttcagcggtttggttggcagggcaatctccagacacaggttagactggcgtaccggggcgacaaccggatcgaacggactgtgagtattgcagtggtcaacgttctggatatagatacgaccggtagaggcgcgttcctgcatcatcagcgagaacagttcgaccgctttcacacgctgtttgcggatgctgtcgtcgttttcatacttcacgtacaggcgttcgaattcgtcctggtcggcgaagaatgcatcgtatagcccgggtacatcggacggactgaacagcgtaatgtcgccgcccttcagcaggcgggtgtacatcagtttgttgatctgtatgccgtagtccatgtgacgtacgcggttgccttccacgccacggttgtttttcagcaccagcaggctttccacttccagatgccacatcgggtagaacagtgtcgccgcgccgccgcgcacgccgccctgcgagcaggatttcaccgccgtctggaagtgcttgtagaacggaatacagccggtgtggaacgtctcgccgccacgaatcgggctacccagcgcacgaatgcggccagcgttgatgccgataccggcgcgctgggaaacgtatttcacaatcgcgctggaggtggcgttgatggaatccagactgtcgccacactcgatcagtacgcaggagctgaactgacgggtcggggtacgcacgccggacatgatgggcgtcggcagcgagattttgaacgtagagaccgcatcgtaaaaacgttttacatagtcaagacgcgtttcacgcggatagttagagaacaggcaggccactaccagaatgtagaggaactgcgcgctttcatagatttcgccggtcacgcggttttgcaccagatatttcccttccagctgcttaacggcagcgtaggagaaggtcatatcgcgatcgtgaacgataaacgaatccatctgcttgaactcttcttccgtgtagtcttccagcagatgattgtcgtatttgccaagctcaaccatttttaccacatggtggtaaagtgcgggcggctcaaactggccgaaggctttcttacgcaggtggaaaatcgccagacgcgcagccaggtattgataatccggcgcatcgcgagagatcaggtctgcggcggccttaatgatagtttcatggatatcggaggtcttaatcccatcataaaactgaatatgcgagcgtagctcgacctgagaaaccgatacgttattcagtccttctgccgcccaatcaagcacgcgatgaattttgtcgagattgatgcgctcagtacggccgtcacgctttgtcaccagcagactctgattcatgtagttttctacctgtttacctgtccgtgaaagaaaaatatcccccccgcttatccacaacgccacgttgtgactaactctgtggataaatactatatatagggggtaatcgataagtgaaacgctatatggtgagtattctagtagggattcttttgagtacaagagttgattttggcgttaaattgcggttgtaaaagagtaagaatcgctaaatgcgcgtctgataaggcctggagaggatgtcaacaattcataaaaaaatcaaaatttgatcgaatgctgattttttcatcgaagagaaaggttgcgcccgatgatctaacgcaacccttataggaaaattctttgatgtcaggcttttttagcgcgggtatgcaacatgtagttaacgtctactccgggaccgagtttgaaagtattggttatcgggttgtagtgcagcccggtgatatgttgctctttcaggacggtttcatctacccagcttaacagttcagcaggcttaatgaatttcttcacgtcgtgcgtgccttttggcaccatgcgcagaatatactcagcgccgacgaccgccatcagccaggatttcccattgcggttcaacgttgagaagaacacctcgccgccgggtttaaccagttgggcgcaggcgtggacgaccgattgcggatcgggaacgtgctccagcatttccatacaggtgacgacgtcgtattgctgggcgtgttttgccgcatgttcctcaaccgtctcctgcacgtactctacctcaatgccgctttccagcgcatgcagtttggcgacctgcaaaggctcaaagcccatatccagcccggtaacggtagcgccttcgcgcgccatgctctccgccagaataccgccgccacagccgacgtcgagcacctttttaccgaacaggccgcctgagcgctcagtaatgtagccaaggcgtagggggttgatgcgatgcaatggcttgaattcgcccttcagatcccaccagcgcgacgcgacggcttcgaatttggcgatttcattatggtcaacgttgtgagctaccgacggtttttcagtgttcatgagtacatgagattccgctattgatctatcggggcagtatagcaggtgcaaagtcgctgcgttatatctactgccgtctttattacgctttcagcgcaagaagttttcttgcgcgttctgtaaaaccgctaccgatgtggtgcgtgataaaattacagacgccctcgacgttgttgttttttaacatatctaaaatagtggcatgtccacggttagagctggtgatatattcagcggtaaaatccagtctgtagcgaattgccaataaacgtgcagagatcaacaggtgtgcttgtgaaatgtatttattatcggcatatttcacaaaaacataatgaaaatcatgatccagtttgaggtaagcttgcgtatctcgctctgcattaatttttgctgacttcgataaaatattgcttaattcgactatgacattgttagcatttttctccatcgcttcacgaattgcgccctgttcaaggataaccctcattttgatgagatcattgatatcctcgtcggtgacagaaaaaacaaatgtcccactgcggggaatgatgttgaccaggttttcattatagctcagccaaataaaagcttcacgaattggtgttttacttatcatcagaatatttgatagttcattttcactgatcgcttgcccaagatcgaaatcgccatggataatcatctcccttattttctctttaatcacctgggtgatggatttgggtatttcaattgatatgtgactaaaatcacgctttaatctatttttcattttcttctcctccatggttaaacccggctccattgtaattaatttattcaaaattaacggatctaatatatcagatataagaaaatttacatactttattgttgttattgtatatttcattaagtttgcttgctgatatatcagatatgacacattagcttttgaattgtattgttttttacgtaacatcgattccggtcaatacccttattcattgaatcataaaaggtgatgcaaaatgagtagtccacaagaaaatttatacgatgcaattcgtattgtaaaaaggaaaatcattcctttggcctttattctttacttttttaactatatggatcgtgtcaatattgggtttgctgcattacgcatgaatgaatctctcggtattacgcctgaggatttcgctaatatttcttctatattcttcatatcatatttaatctttcaaattccgagtagcattggcttgcaaaagcttggcgcaagaaaatgaattagttccattattatcggctggggagcggtaacagggctgattttttttgctaaagatactcaacatattttgctggctcgcatttttttgggggtatttgaagctggctttttcccgggcatggtttattatcttgcatgttggttcccggctcgtgaacgcggaaaagtcaatagtttcttcatgttatctattgctgttgcatcggtattggctgcaccgatgtctggttggatcatcgagcatttgaataccccggattatgaaggctggcgctggctttttgctattgaaggtatccctaccgtattccttggcatcctgacattttatttactgcctgacagtccagaaaaggctaaatggcttacgccacagcagatatcggccttagttaataaattacgcactgacaatgaaaccgcagctgcattaaataaaaataccaactcatcctttctttccgtaatcaaaaatccagttttgcttcagctttctttcgcctacatgttgattcaggcggctgctctggcggcaaactactggttgccggggttggtgaagggattttcagctgattttacggatactgacgttggtttaatcatgagtattccgtttattttcgctatgttcagcatgccctggtggggctggcattccgataaaaagaatgaacgaaaatggcatgctgcattacccatgtttctggcaggctgtggttttctgatgattgctcttgtcccctcaatgtcgctgagaatgctggggctaacgttctatggtgttgggatcctcagctattacggaccttactgggcgctgccttctgcattattgtcgccgtcagggttggctatcagcattgcgtttattaactcatgtttaagtcttggcggattcctgattaataagtcactgggattcgtttctactcattatggtgcgacaggaatatttattgtagaggcaatactttgcttcgctgcggtagccgttttggcgttaatgaaaattgatgtgaaaaaagaaaaaagccaacaaacaaatgttgtatcacgaacctgataaatggagaaattatgaaaattacgtctattgaagtttttgactgtgaattaaaaaaaagagatcaaacgatgtcatcctataatccagtacttatccgggtgaataccgactcaggattaagtggtattggcgaagtaggactggcctatggcgcaggcgctaaagctggcgtagggatcatcagagatctggcgtcattgattgtgggtgaagatccattaaatatcgaaaaaatttgggagttctttttcagaaagactttttggggaatgggaggcgggaacgttttttatgccggaatgagcgctattgatattgctctttgggatatcaaaggtaaatatttaggtgtacctgtttatcagctccttggcgggaaaactaatgaaaaattaagaacctatgctagtcagttacaatttggttggggggataaacgccagatattagtgacacctgaggaatatgctgaggcggcgcgtgcggctcttgacgatggatatgatgcgattaaagtggatccactcgaaatcgatcgtaatggcgatgactgtgtttttcagaatagaaatcgtaactattcaggattgttactggccgatcaattaaaaatgggggaagcgcgaattgccgctatgcgtgaagcaatgggggatgatgctgatattatcgtagaaatccattctcttctcggtacaaactcagctattcaatttgcgaaggcgatagaaaagtatcgtatctttctttatgaagaaccgagccatccattaaattctgataatatgcagaaagtttcccgttcaacaacgattccaatcgccactggcgagcgttcctacacaagatggggatacagggaattactggagaaacagtctattgccgtagcgcaacctgatttgtgtctctgcggcggaattaccgaaggaaagaaaatctgtgactatgctaatatttatgacaccactgtacaggtgcatgtttgcggcggtcctgtttccacggtagccgcgctgcatatggaaacggcaattcccaactttattattcatgaacatcataccaatgcgatgaaagcatctattcgggaactttgtacccacgattatcagccggaaaatggctattatgtcgcgccggaacagcccggattgggtcaggaattaaacgatgaggtagtgaaagaatacctggcctatgtgattaaatagcatctggtgatactgattatggtttatgcctcccggcatatcccctaaataattcgagttgcaggataaaatggttaaccgtcttgaacagcgcttgcgctaaccccgacggggcgaggcccagggatgggccgagtaacttgccgccaacgcacatgaaacttgaagtatgacgggtatacacgggaggtattgattttccagcctattcctggccaggcccagatctcctctgtgtcgcctctgaagctgatcgccgataaacgccgagaccacgcttataaatgaagagagcatgtggcacccgaataaagcattgtctggctgcattccgtttaccagtacgtgggcgaatgtgttataatttgcgacctttgaatccgggatacagtagagggatagcggttagatgagcgaccttgcgagagaaattacaccggtcaacattgaggaagagctgaagagctcctatctggattatgcgatgtctgtcattgttggccgtgcgctgccggatgtccgagatggcctgaagccggtacaccgtcgcgtactttacgccatgaacgtattgggcaatgactggaacaaagcctataaaaaatctgcccgtgtcgttggtgacgtaatcggtaaataccatccccacggcgattccgcagtgtatgacaccatcgttcgtatggcgcagccattctcgctgcgttacatgctggtggatggtcagggtaacttcggttctattgacggcgactccgcggcggcaatgcgttatacggagatccgtctggcgaaaatcgcccacggactgatggccgatctcgaaaaagagacggtggatttcgtggataactatgacggtacggaaaaaattccggacgtcatgccgaccaaaattccgaatctgctggtgaacggttcttccggtatcgcagtaggtatggcgacgaatatcccgccgcacaacctgacggaagtgattaacggctgcctggcgtatatcgacaacgaagacatcagcattgaagggctgatggaacatattccgggtccggacttcccgaccgccgcgatcatcaacggtcgtcgtggtatcgaagaagcctaccgtaccggtcgtggcaaagtgtacattcgcgcccgcgcggaagttgaagctgacgcgaaaacgggccgtgaaaccatcatcgtccatgaaattccctatcaggtgaacaaagcgcgcctgatcgagaaaatcgccgagctggtgaaagataaacgcgtggaaggcatcagcgcgctgcgtgacgaatccgacaaagacgggatgcgcatcgtgattgaagtgaaacgcgatgcggtgggcgaggtggtgcttaataatctctactcccagacccagctacaggtttccttcggtattaacatggtggcgctgcatcacggccagccgaagatcatgaacctgaaagatattatttcagcgttcgtgcgccaccgccgtgaagtggtgacgcgtcggactatttttgaactgcgtaaagcccgtgatcgtgcgcatatccttgaagctctggcgattgcgctggccaacatcgacccgattatcgaactgattcgccgcgcgccgacgccggcggaagcgaaagcggcgctgatttcgcgtccgtgggatctgggcaacgttgctgcgatgctggagcgcgccggtgacgacgccgcgcgtccggaatggctggagccagaatttggcgtgcgtgacggtcaatactacctgactgaacagcaggcgcaggcgattctggatctgcgtttgcagaaactgaccggcctggagcatgaaaaactgctcgacgaatacaaagagttgctggagcagatcgctgaactgctgcatattctgggcagcgccgatcgcctgatggaagtgatccgcgaagagatggagttaattcgcgatcagttcggcgatgagcgtcgtaccgaaatcaccgccaacagcgccgatattaatatcgaagatctgattagccaggaaaatgttgtcgtaaccttgtctcatcagggctatgtgaaatatcagccgttaaccgattacgaagcacagcgtcgtggcggtaaaggcaaatcagcagcacgtattaaagaagaagactttatcgaccgcctgctggtggccaacacccatgacaccatcctttgcttctccagccggggccgtctgtactggatgaaggtctatcagttgccggaagccagccgtggcgcgcgcggtcgtccgatcgttaacctgctgccgctggaagccaacgaacgtatcaccgcgattctgccggttcgtgagtacgaagaaggcgtcaacgtctttatggcgaccgccagcggtaccgtgaagaaaacggcgctgaccgaattcagccgtccgcgttccgccggtattatcgcggtaaacctcaacgacggcgacgagctgattggcgttgacctgacttctggttctgacgaagtcatgctgttctcggccgcgggtaaagtggtgcgcttcaaagaagacgccgtccgtgcgatggggcgtaccgcgaccggtgtgcgcggtattaagctggcgggagacgataaagtagtttctctgatcatcccacgcggcgaaggcgctattctgaccgtaacgcaaaacggctacgggaagcgtaccgcagcggacgagtacccgaccaagtctcgtgcgacgcagggcgttatctctatcaaagtgaccgagcgcaacggttccgttgtcggtgcggtacaggtagacgattgcgaccagatcatgatgatcacggatgccggtactctggtgcgtacccgagtgtctgagatcagcgtggtgggacgtaatacccagggcgttatccttatccgcacggcggaagatgaaaacgtagtgggtctgcaacgcgttgctgaaccggtagatgacgaagaactcgatgctatcgacggcagcgtgacggaaggggatgaggatatcgccccggaagcggaaagcgatgacgacgttgcggatgacgctgacgagtaatattattgctgtgcgagggccggatatccggccctttttcttgtctatggaaaacccccagctaggctgggggttccggaaagctttcagctttaagccagttattaaaaccccttttgatttgttaaaacatcttgcggtctggcaactgcaaaagttcaacaagaaatcaaaagggggtcccaatgggggacgaaaagagcttagcgcacacccgatggaactgtaaatatcacatagttttcgcgcccaaataccgaagacaagcgttctatggagagaagcgtagggcagtaggcagcatattaagaaaattgtgtgaatggaaaaacgtacgaattctggaagcggaatgttgtgcagatcatattcacatgcttctggagatcccgccgaagatgagtgtgtcgagtttcatgggatatctgaagggtaaaagtagtctgatgctttacgagcagtttggggatctaaaattcaaatacaggaacagggagttctggtgcagagggtactatgtcgatacggtgggtaagaatacggcgaagatacaggactacataaagcaccagcttgaagaggataaaatgggtgagcaattatcgatcccgtatccgggcagcctgtttacgggccgtaagtaacgaagtttgatgcaaatgtcagatcgtatgcgcctgttagggcgcggctggtaagagagccttacaggcgcatcagaaaaacctccggctatgccggaggatatttattttgccgttgcgggctacgtcatttaccgctaccttagtcacactctatttacatcctgaggcggagcttcgcccctttgaaataccttgcttcctttcgaactacgctgaaagtctcgcgctacttattcagagcgttagcgttactcatttggctcttaatcgcctttgtttcggtgttttacatcgtcaatgccctgcaccagcgggagtctgaaattcgtcaggagttcaaccttagctccgatcaggcgcagcgttttatccagcgcacgtcggatgtgatgaaagagctcaaatatatcgccgagaaccgtttaacggcggaaaacggcgtcatgtcgtcgcgtgcgcgtgatgacaaaatggtggtgccggattttgaaccgctattcgccgactcagactgtgcggcgatgggctccgcctggcgcggctcgctggagtcgctggcctggtttatgcgttactggcgcgacaacttttcagcggcgtatgatcttaaccgcgttttcctgattggcagcgataacctctgtatggcgaatttcggcctgcgtgaaatgcccgtggagcgcgatgatgcgttaaaagcgttacatgagcggattatgaaataccgcaacgcgccgcaggaagaaagtgggaataaccttttctggataagccagggcgcgcgtcagggcgtgggctacttttatgcgctgacgccggtgtatctggccaatcgtctgcaggcgctgctgggcgttgagcagtccatccgtatggaaaattttttcacgcccggcagtttgccgatgggcgtcactattattgatgagaacggccattcgctgatttcgttgaccggtcctgacggcattattaaagcggagccgcgctggatgcaggagcgttcctggtttggttatacgccaggttttcgcgaactggtactcaaaaaaagcctgccgccatcctcgctcagtattgtctattctgtgcctgtagatttagtcctggagcgtattcgtattcttatcctgaacgctatcctgctgaacgtgctggtgggcgcagggctgtttacgcttgcgcggatgtatgagcggcgaattttcattccggcggagagcgatgcccagcgtctggaagaacatgaacagttcaaccgtaaaatcgttgcctccgcgccggtggggatctgtattctgcgcactattgatggtgtcaatattctgagtaacgaactggcgcacacctacctgaacatgctcacgcatgaagacagacagcgcctgacgcaaatcatttgcggccagcaggtcaactttgttgatgtattgaccagcaataataccaatttgcaaattagcttcgtccattcccgctatcgtaatgaaaacgtcgcgatttgcgtgttggtagatgtgagtacgcgcgtcaaaatggaagagtcgctgcaagagatggcgcaggcggcggagcaggcaagccagtctaaatccatgttccttgcaacggtcagccatgaattgcgcacaccgctgtacggtatcatcggcaatctcgatctgctgcaaaccaaagagctgccaaaaggcgtggatcgtctggtcacggcgatgaataacttctccagtctgttgctgaaaattatcagcgacattctcgacttctcgaaaattgagtcggaacagctaaagattgagccgcgcgaattttcaccgcgagaggtgatgaaccatatcaccgccaattatctgccgctggtggtgcgtaagcaactcggcctgtattgttttattgagcctgacgtgccggtatcgctgaacggcgacccgatgcgtttacagcaggttatttcaaacctgttgagcaacgccattaagtttaccgatattggctgcatcgtgctgcatgtgcgctgtgatggggattatctcagcattcgcgtgcgggataccggggttggtattccggcaaaagaggtggttcgcctgttcgatcccttcttccaggtgggaaccggcgtacagcgtaactttcaggggaccggtctggggctggcgatttgcgaaaaattgatcagcatgatggacggcgatatttccgtcgattcggagccgggcatgggaagccagtttacgttgcgcatcccgctttatggcgcgcaataccctgtgaaaaagagcgtggaaggactcgccggaacctgctgttggctggcggtgcgcaatacttctttgtgccagtttattgagaccagtctggcgcgtagcggcgttcatacgcagcgttatgaagggcaagaacccgccgcagacgatattttgattgtcgatgacgcgctggagcatacctggcaggggagggcggcggtcgtcttttgccgccgtcatatcgggattccattggaaagagcgcctggcgagtgggtgcatagtgtggcgtcggtgcatgagttgcccgcgctgttggcgcgtatctatagtattgagctggatagtgaagcgctttccagcgcattgccgacgacggataaaaccgcagattcaaatgacgacatgatgattctggtcgttgacgatcatccgatcaatcgccgcttgctggccgatcaactgggatcgctggggtatcagtgtaagacagccaatgatggcgtggacgctctgaatgtgctgagtaaaaatgctatcgatattgttctgagcgatgtgaacatgccgaacatggacggctatcgcctgacgcagcgtatccgtcagcttgggctgacgctgccggtcgtcggcgtgacggcgaacgcgctggcggaagagaaacaacgttgcctggagtccggtatggatagctgtttgtcgaagcctgtgacgctggatgcgttgaaacagacgctggcggtgtatgccgagcgggtacgtaaaacgcgggcataaaaaatgccggatggcggcgtcgcctgtccggcctgtaaaagatgagtcgactggtaggcctgataagcgtagcgccatcaggctgggtaacataaaagcgatttattctttgtctgtcggactcagggtgacggaagagagatagttgagcagcgcgatatcattctctacgcccagtttcatcatcgccgatttcttctggctgctgatggtcttaatgctgcggttgagcttcttggcgatttcggtgaccaggaagccctcggcgaacaggcgtaatacttcgctctcttttggcgacaggcgcttatcgccgtaaccgcctgcgctgattttctccagcagacgagaaacgctttccggggtgaattttttgcctttttgcagcgcggccagcgccttaggcagatcggttggcgcaccctgtttgagtacgatcccttcaatatcaagatccaacacggcgctcaggatcgccggattgttgttcatggtcagaacgataatagacaggctcggaaaatgacgcttgatgtacttgatcaaggtgatcccatcgccgtatttatctcccggcatggagaggtcagtgatcaacacatgcgcatctaatttcggcaggttgttgatcaatgctgtggaatcttcaaattcgccgacaacattcacccactcgatttgttcaagtgatttgcgaataccgaacagtacaatcgggtggtcatcggcaataattatgttcatattgttcatgtattgggctactttgctacagcaagcttttgacgtaggcgtcaatgtcgctgatatatttttctatacctggagcatctttctcacgaatcagatgttccagcgttacacataactgcttgccgggtaccagattaagcatggcaaacacccctttcaggcggtgggccgtttgggccagcgcagcgaaatcgctggttgccgcctcagtatacaacctcttaacatcatccggtactgtgtctacaaatagcgcataatagccgctggcatgaagctcggcattttcatctccgccgagcggggaggcgggaatctcttcctgcgccagctgctcttcgataagttgtagtacagcttcctgcatagcattgctcatattaaagttgacgcgcaactgacccgggccaattttccgcacgcctgactcatcatcgcttaaaagcaagcccgaggcagtaagattagacggattatccgttaaaaagagatcatattcttgacttatctgcctttcatccggcgtgatgcaggtggcgccccagttttctaactgacgcagcacaatcgcgcgaacctcgttggacgtcacatcgaccatcacgctcacgtcgtccagcaggcgctcttcgacctgagtatgctgatcgtgaggaagcattttgacatgaacggtatagcgcgtgcccagcgtttctcgcgctttaatgttgagatgaccgcccagtttgcgcgccagttgattgcacagccagaaggtgagcggattcgctttgccgtaacggtcgccctgcgtttcattcatatacgggaaatgcagattatcaatctcgtttaacgttacgccttcgcccgtatccagaatacggaaagtcagacgctccgcgatagattcatcctgctcgacttcaagcgtaattttacccatagcggtcgtcgtgacggcatactgaatcaacagcagcaaaatccggcgcagggcgtcgcgatcgccccagcgttcatcgttgccgctaagatggttattaatcagcagttgcagccctttacgcttaatggcgggcagcacttccggcacgacttcgtcaataagatcctgcagggagaacagcgtggtttcgcttttccatgcgtcattttccagcatattcgccagttggatttcatcgatcatacgtactaatacatccgcctgatccgccagtttcaggctttccggcgtggtgactgccgcggcgttaaccgccagttggcgtacgggctctttaagcgtgttgctgatattttgcataaaggcggcgcggccctgctgattcttctcatacaaacgctgcgcctgtttaagcttcttattcaccagcacttcccggtcctgatcgcgaataataaagatctgcgtgcggggggcgatctggctgcgaaacagacggatctcatacagttcgttattaattgtcgcctgaatcacgccctgatgctgctccgccatgctggtaatattttgcaggttaagatgcggcaacagatgatcggcgattttattgctgatcacggtgcggttgccttcctgatcgtagaccagcagacccagcggcagcagagaaacgatctcttcattaatggcgcgtaagacgcgaagctcattattcgccgcgttgccggatgtcgattccgtcgaccgtcccggctgatgacggaacgtggcgtagccaaataacgccaacgccagcagcccgatgttcagcagtaaaggcagcaaaatattttgcaacgtatcaagcaaaagcgtaccgaacggtacctgccagatcaggcgcattccggtagagttaagcgctgaggagatctcaatttttgaaccgttaaagctaatcgtgacgctatctggcgcttccttttcactgcttcgccccgtcgtctgggttgcgtcaggctctatccgaaaactgtccagcggcattcccggcgggattaaatcattaatgggcagatcaaacgccaccacggttgccagatgtcctggctgattgaaggtcgtgcgcagcgtaaaatagtgaccgttttgccaggccagttttcgcaatgaggagaaactttcgcgctcatccagcgcattcgcctgctgcaacatctctgcccggcgggaatcgacgatattgccaatagtggactctttaaagccggaagagagatctttcaacggtagggtagagataagaatcaggctgttatcctgtccgttgaggtaatacattgaccacggcacgttttccgcgccccacagcgtatccagataagttgacatacgctgcgtcatttccagcgtggcgctgtcatgggaaccgaaaatcagcgcttcagttttacgtcgcggcttttcaagataatacacatcctgtttcagacgcgtttcctgaagtccttcacctgtcgatggcgtagtggtcgcggcgatgttgtcataaatttgccaggtaacataccgccaggtgtccacgcgtttatgaatagcgtgagtgatatcgacaatttgatagcttttgtctttcaaccaggcgttgacggcgctctgtaccataacgcccatcgttaccagcagcacaatgatcagcaataagaagaaacgggtaatgcttcccggtagaagggagaatcgggtagagaccgttgtgtcagactgactcatttatgtttacgacctgtaaaagcaacgctgaaggtgaagggcagtataaagggtaatgaatgaatttccagactcttacgtcatgccgggcaacttaacacgcgctccgtcggcgggacgggaaaagcgtacaaccttcgcaaaacggtacaaatataaagactacttataaatgtttagcactaaatatcaagaaattatttgctaatgtcttatgaacggtcgagcaggggagggtagtgaataaccgtgatagttttaggcaggtagcataaatcagccgggtgtgtctgaaaaagggtaaaaaaaccgaatgtgaagcatccggttgaaataggggtaaacagacattcagaagtgaatgacggtaataaataaagttaatgatgatagcggtcactattttagttgcgaatgaagattctgttttatcattcagtgctatgaatttcatcaatttaacccgttgattttaaaagtttcgtgaatatattttgtctatttgtgcttatttttacttgatttttgctttaaaaaagttccgtaaaattcatattttgaaacatctatatagataactgtaacatcttaaaagttttagtatcatattcgtgttggattattctgtatttttgcggagaatggacttgccgactggttaatgagggttaaccagtaagcagtggcataaaaaagcaataaaggcatataacagagggttaataacatgaaagttaaagtactgtccctcctggtaccagctctgctggtggcgggcgcagcgaatgcggctgaaatttataacaaagacggcaacaaattagacctgtttggtaaagttgatggcctgcactacttctctgacgacaaaggcagcgacggcgaccagacctacatgcgtatcggcttcaaaggcgaaacgcaggttaacgatcagctgaccggttatggccagtgggaatatcagattcagggcaaccagactgaaggcagcaacgactcctggacgcgtgtggcgtttgcgggtctgaaattcgctgacgcaggttccttcgattatggtcgtaactacggcgtaacctatgacgtgacctcctggaccgacgttctgccggagttcggcggcgacacctacggcgctgacaactttatgcagcagcgtggtaacggctatgctacctaccgtaacaccgacttcttcggtctggtggatggtctggacttcgcgttgcagtatcagggcaaaaacggcagcgtgagcggtgaaaacaccaacggtcgcagcctgctgaaccagaacggcgacggttacggcggatcgctgacttatgcaatcggcgaaggcttctctgtcggtggcgctatcaccacgtctaaacgtactgccgatcagaacaacaccgctaacgctcgcctgtatggtaacggcgatcgcgccacggtttacaccggcggcctgaaatacgatgcgaacaacatctatctggcagcgcagtattctcagacctataacgcaacccgttttggtacctctaacggcagcaacccgtccacctcttacggttttgccaacaaagcgcagaactttgaagtggttgctcagtaccagttcgactttggtctgcgtccgtctgtggcttacctgcagtctaaaggtaaggacatcagcaacggctacggcgccagctatggcgaccaggacatcgtaaaatacgttgatgtcggcgcgacttactacttcaacaaaaacatgtccacctatgttgattacaaaatcaacctgctggataaaaacgactttacccgcgatgcgggcatcaacaccgacgacatcgtagcgctgggtctggtttaccagttctaatcagcaaaagatgttgctaaagggcctgcgggcccttttttcatgccttattccggcgtacaaatacgacgttttgatatacgcttgcgtccattcgaatgaggataaacagcgatgaaaatgactttttgccgggccgtgtgtctggcagcggcttttttacttatgggctgcgatgaggctcccgaaacgacaacagcgtcacctgccgctcaggtgctggaaggtaaaacgatgggaaccctctggcgggtgagcgtggttggtatcgatgcgaaacgtgccgcagagttacagactaaaatccagactcagcttgatgctgatgattggttgctttctacctataaaaatgactccgcgctgatgcgttttaaccattcacgcagtcttgcgccctggccggtcagcgaagccatggcggatatcgtgacctcggcgctgcgtattggcgcgaagacggacggcgcgatggatatcaccgtgggcccgctggtcaatctgtgggggtttggaccggatcggcagccgctgcatatcccaacaccagcacaaatcgatgcggcaaaagcgaaaacaggcctgcaacatttgcaggttatcgacagggctggacatcagtttttgcaaaaagatctgccggatctttatgttgatctctccacggtcggggagggctatgcggcggatcatctggcgcgtctgatggagcaggagggcattgcgcgttatctggtctcggtgggcggcgcattaagcagtcgcgggatgaatgcgcaggggctgccgtggcgcgtcgcgattcagaagccgaccgaccgggaaaacgcggtgcaggcgattgtggatatcaacgggcatggcatcagcacctccggcagctaccgtaactattacgagctggatggcaagcgcgtatcgcacgttatcgatccgcaaacggggcgccccattgaacacaatctggtatcggttacggtcatcgcgccaacggcgctggaagcggacggctgggacaccggcctgatggtgctcggtacgcaaaaggcgcaagaggtcgtgcggcgggaagggctggcggtctttatgatcatgaaagaaggtgaaggctttaaaacctggatgtcgccgcagttcaaaacattcctggtgagcgataagaattaaaacgcaagattacgggtttttgtgggcggatttacggacacactgcatgtaagcaagcactatgcttaatgaaggagtctatgatgaaaaaagcgttacttaccgatgatgaatgctggctgcgggtgcaggcgcgcgatgccagcgcggatgggcgtttcgtttttgcagtgcgaaccactggcgttttttgccgcccttcttgtcgctcgaagcgggcgttacgtaaaaatgttcgcttttttgccaacgcgcagcaggcgctggacgccggttttcgcccctgcaagcgctgtcagccggataatgcgcgcgcgcagcaacggcggttggataagattgcctgcgcctgccgtttacttgagcaggagacgccggtaacgctggcgtctctggcgcaggcggtggcaatgagtccgtttcatctgcaccgtttgtttaaagcgagcaccggaatgacgccgaaagggtggcagcaggcgtggcgcgcccggcggctgcgtgaggcgttggcgaaaggagagccgatcacggcggctatttaccgcgccggcttcccggatagcagtagctactatcgtcatgccgaccagacgctgggcatgacggcaaaacagtttcgcaaaggcggcgataatgtctccgttcgctatgcgctgacggactgggtttacggacggtgcctggtggcggagagcgggcgggggatttgcgcgattctccccggtgatagcgacgatgcgctactggccgaattacacacccttttcccggcggcccgccacgaacctgctgacgcgccttttcagcaacgggtgcggcaggttgccgcggctatcaacacacgcgatgtgctgctctcgttgccgctggatatccagggaaccgcgtttcaacagcaggtctggcaggcgttatgcgcgattccctgcggcgaaaccgtaagctatcaacagcttgccgcgactatcggcaaacccacggcagtacgcgcggtcgccagcgcgtgcggcgcgaataaactggcgatggtgatcccgtgtcatcgggtcgtgcgtcgcgatggcgcgctctccggttatcgttggggcgtgcgtcgaaaagcgcagctattaaagcgagaagcgcaaaaagaggagtagcaatgctggatctgtttgctgatgaagcgccctggcaagagcccctggcgcctggcgcggtggtgttgcgccgctttgcgtttcgcgcggcgcagtcgctattagacgatatcggatttgtcgccagtcagtcaccgtttcgtcagatggtgacgccgggcggctacactatgtcggtggcgatgaccaactgcggcgcgttagggtggaccaccgatggtcacggttattgttatgccgtgcgcgatccgttgaccgataaaccctggcctgtgctgccgttatcgtttgccagcgtatgtcgtcaggcggcaatcgcggcagggtatgctagcttccaaccggacgcctgcctgatcaatcgctacgcgcctggcgcaaaactgtcgctgcatcaggataaagacgagccggatctgcgcgcgcctatcgtctcagtttcgttgggggtgccggcggtttttcagtttggcggcctgcgtcgcagcgatccgctccagcggatcttactggagcatggcgatatcgtggtctggggcggcgagtcccgcctgttttatcacggtatccagccgcttaaagcgggctttcatcccatgaccggtgaatttcgttacaatctcaccttccgtcaggcggctgaaaaagaataaaaataagaattattattgctgtgcaggtagagttagttaaactgcgggctgttattatcggtccgggttgtatgcatggaacttcttattcttgtctggcggcagtaccgctggccatttattagcgtgatggcgctgagcctcgccagcgcggcgctggggattggcctgatcgcgtttatcaatcagcgcctgattgaaacggtggacaccaccgtcatggtgctgccggaatttctcggtctgctcctgttgctaatggttgtcacattaggttcccaactggcgctcaccgctctgggacaccatttcgtttaccgcctgcgcagcgaatttatcaagcgcattctggatacgcacgttgaacgcattgagcaactgggcagcgcctctttactggccggtctgaccagcgatattcgcaatattactatcgcctttgtgcgtctgcctgagctggtgcagggcattgtcctcaccgtcggctcggcggcgtatctggcgatgctatcgacaaaaatgctgctggttacggctatctggatggcggtcactatctggggcggattcgtgctggtggcgcgggtttaccagcatatggcgaccctgcgcgagaccgaagataagctgtacaacgactatcagacggtgctggagggacgcaaagagctgacgctaaaccgcgagcgtgcggagcagatttttcagcaatgctataccccggacgccaaagagtaccgtcatcacattatccgtgccgatacttttcacctgagcgccgtcaactggtcgaatatcatgatgctgggggcgataggcctggtcttctggatggcgaatagtctcggctgggcggataccaacgtcgcggcgacctattcactgacgttgctgttcctgcgcacgccgctgctgtctgcggtgggggcgttgccaacgctactgaccgcccaggtggcgtttaataaactgaataaattcgcgctcgccccgtataagcctgattttccacagccgaaagcctttcccgactggaagacgctggagctgcgcaacgtggtttttcactatcaggataacgcgttttccgtggggcccatcaacctgacgattcaccgcggcgaactgctgtttttaattggcggcaacggtagcgggaaatcgacgctggccatgttattgaccggtttataccagccgcaatcgggaacgattttacttgacggtcaacctgttgccgccgggcagccggaagattatcgcaaactgttttctgcggtgttcaccgatgtgtggttattcgaccgcctgctggggccgcaggggaaacccgccaatcccgcgctggtcgaaaagtggcttgagcacctgaaaatgacgcacaagctggagctaaacgatgggtgcatcttgaatcttaaactgtcgaaagggcaaaaaaagcgcattgcgctgctgctggcgctggcggaagagcgcgatattattttgctggatgagtgggccgccgatcaggacccgcatttccgccgggaattttatcaggtactgttgccgttaatgcaggaaatgggcaaaaccattttcgccatcagccatgatgatcactattttattcacgccgatcgcctgcttgaaatgcgtaacgggcagttaaccgaactcaccggcgacgaacgtgacgccgcttcgcgtgatgcggttgcgcgtactgcgtaatggactatggcgccggataaactgcctgatggcagccctacgtccgcacgcgggtaggcctgataagatgccacgcgtcgccaccaggcatcggggtattttttgcggcgggcgagcgggtttccagacgtgttttaaaaagaaccccggagcgctgcgtgagtcggcgtgttcagatgcccggtaagtgtgaccgggcagcgtaacattatcgcgcgatggcattctgtacgttagcgtccgctttccagatgcggtatttcacgtccacattcgccggggtatacaccacgatcggcagcttgctgttgtagcgcagcatcccgtcttcacccagccaggcggtgacgaatttttgctctttcttaccttcagggcaggccatcatggttgataccggagaggtgacgttatcaaagacataatagtcgtagccccagccttccagcgtttttgtttccagcgtgccgccgaggcgatgctggttacaatccacattcagcgtttgaccaatcaacagttccactttgagggtagattcatcctgctgaggggtaagggttatcacttgccgcttcattcctttctccgcctgcggatagggggcgattttttccagcggctgggcggtatcgccattgttagcccaggcagaggcgctggcgagggcggcgaagacgacggcagggacaaacatcttcatttgattgttcacagtatttcctttctgctgttttcggtatgcacagacaacagattaacacattcatattatctattaatctgtatttactcatattttcaagattattaataaaataacgtctttttatatagtggaatattctgatattgataatgtaaatgaaattatcagctattagtgatttccgttatataaatatctatataactcattgaaatgtgagaaaaagcacgtttacgggtctttacccggcactcttttgatccggcaacagcatttacctctatcggggtatgcatctcttacacatcctgaaatatcttatttacaaaaataactactcataaattgtacggtttttattggcattcactccctatggaagcgtgtcgttatggaagggcgatatcatggttgatttatcccgtcgaagcatgttgaccggcagttggcgcaacgccagcaatgggattcttccgccgtgggccagagaaacgacctattttctcgcacattgtctgcgttgcgacgcctgcatccaggcgtgtgaggccgacatcctgcagcgagggacggggggatatccgagcgtaaatttcaaacggggcgagtgcagcttttgttatgcctgtgcgcaggcctgtcccgaatctctctttcttccgcgccgcaccagggcctgggatctgatttttacactcacggaaaactgcctcgccaggcagtcggttgaatgccatcgttgcctggacagttgtgaacctatggccattacctttcgtcccacgttatccggtatttaccagccgcagcttgactcgcaggcctgtaacggatgcggggcgtgtgtggctatctgtcccgtgtcagccatcaaagcggagaaccaccatgcgcactaactggcaggtctgtagcctggtcgtgcaggccaaaagtcagaacatcgccgccattggcacacagttgaacacgttgccgggttgcgaagtcgcgttaagcgacgttgaaagcgggcaactgatcgtggtggcggaagcagaccagagtgaaacgctgatgcaaacaattgagtcagtacgcaatgtcgagggcgtgctggcggtgtcgctggtttatcaccagcaggatgagcaaggtgaggaaacaccatgaaactcagtcgtcgtagctttatgaaagctaacgccgttgcggccgctgcggcggctgccggtctgagcgtgccgggcgtcgcccgcgccgttgtcgggcagcaggaagctatcaaatgggataaagcgccgtgccgtttttgcggaacgggttgcggtgtgttggtgggaacgcagcagggccgtgtggtcgcctgccagggcgaccccgacgcgccggtcaaccgtggtctgaactgcattaaaggctacttcctgcccaaaatcatgtacggtaaagatcgtctgacgcagccgatgctgcgcatgaaagacggcagctatcacaaagacggcgagtttacgccggtgagctgggaacaggccttcgatgtgatggaagagaagtttaaaaccgccctgaaagagaaaggaccagaagcgatcggcatgtttggatcgggtcaatggaccatctgggaaggctatgccgccgcgaaactgttcaaggctggtttccgctctaacaacatcgacccgaacgcgcgtcactgcatggcctcggcggtggtgggctttatgcgcacctttggcatggatgaaccgatgggctgctacgacgatattgagcaggccgatgcgtttgtgctgtgggggtccaacatggcggagatgcacccgattttatggtcgcgcatcactaaccgccgtttgtccgacccgaatgtgaaagttgctgtcctctccaccttccagcaccgtagctttgagctggcggacaacggtattgtctttaccccgcaaagcgatctggtgatccttaactatatcgcgaattacattattcagaacaacgcggtaaatcaggatttcttcacaaagcatgtgaatctgcgtaaaggggcgacggatatcggctacggcttacgcccgacgcacccgctggaaaaagcggcgaagaatccgggctccgacgcttccgagccgatgagcttcgacgagtataaagccttcgtggcggaatatacgttggacaagactgctgaaatgaccggcgtgccgaaagatcaactggaacagttggcacagctctacgccgatccgaataagcgcgtgatctcttactggacgatgggttttaaccagcatacccgcggcgtgtgggcgaataacctggtttacaacctccatctgctgaccggaaaaatctcccagcctggctgcggtcctttctcgctgaccggccagccttccgcctgcggtacggcgcgtgaagtgggaaccttctcacaccgtctgcccgcagacatggtcgtgacgaacgaaaaacaccgtgatatctgcgaaaaacactggcagatccccgctggcactatcccggcaaaagtgggtttacatgcggtggcgcaggatcgcgcgttgaaagacggcaagctgaacgtctactgggtaatgtgtaataacaatatgcaggccgggccgaacatcaatgaagatcggatgccgggctggcgcgatccgcgtaactttatcattgtctccgatccttacccgacggtgagcgcgctgtctgctgatctgatcctgccgaccgccatgtgggttgagaaagaaggcgcttacggcaacgccgaacgccgcacgcagttctggcgtcagcaaattaaagcgccgggcgaagccaaatccgacctctggcaactggtgcagttctcccgtcgttttaaaaccgaggaggtctggccggaggcgttgttggcccagaagccggagctgcgcggcaaaacgctgtatgacgttctattcgccacgcctgcggtcagcaaattcccgctgagcgagctgaaagaagatcagttaaacgatgagtctcgtgagctgggcttctatctgcaaaaagggctatttgaagaatacgcctggtttggacgtggccacggtcacgatctggcgccgttcgacgattaccacaacgcgcgcggtctgcgctggccggtcgtcgaaggcaaagagacgcaatggcgttacagcgaaggcaacgacccgtatgtaaaagcgggggaagggtacaaattctacggtaaaccggatggcaaagcggtgatcttcgcgctgccatttgaacccgcggcggagtcgccggacaacgagtacgatctgtggctttccaccggtcgcgtactggaacactggcataccggcagtatgacgcgccgcgtgcctgaattgcatcgcgccttcccggaagcggtggtctttattcacccgctggatgcgaaagcgcgcgatctgcgtcgtggggataaggttaaagtgtcgtcccgccgcggcgaagtgatttcgattgtcgaaacgcgtggacgtaaccgtccgccgcagggactggtgtatatgccgttcttcgatgccgctcagctagtgaacaacctgacgctggatgcgacggacccgctctctaaagagacggacttcaagaagtgcgccgttaagctggcgaaggtgtaacgcgttatgtcccgtacagcgaaaccccaaaatggccgccgccgctttctgcgtgatgttgtgcgcactgcgggcgggctggcggcggttggcgtggcgctgggcttgtaacagcaaaccgcgcgcgcaacgggcgtgcggctgcgtccgcctggcgcgctgaatgaaaatgttttcgccagcgcctgtgtgcgctgcgggcagtgcgttcaggcgtgtccatacgacacgctaaaactggcgacgctggcctccgggctatcggcaggtacgccctatttcgtcgctcgcgacatcccctgcgaaatgtgtgaagacattccgtgcgccaaagtctgccccagcggggcgctgaataaagatatcgcctccattgatgactcgcgcatggggctggcggtgctgctggatcaggaaaactgcctcaactttcaggggctgcgctgcgacgtttgctaccgcgaatgcccgaaaatcgatgaggccatcacgctggagctggatcgcaacatgcgcactggcaaacatgcgcgctttctgcccaccgtacacagcgacgcctgtaccggctgcggcaaatgcgaaaaagtctgcgtactggagcaaccagcgataaaagtgttgccgttgtcattggcgaaaggggagttaggacaccattaccgcttcggctggctggaggggaaagatggcaaatcgtaaacgcgacgccgggcgagaagcgcgggcgaaaaaaggctggtggcgtagccaccgttggctggtgttacgccgtatcagccagtttatggtgctggggatgtttctcagcggcccgtggctgggcttttgggttttgcatggcaactacagcagtagtttgctgttcgataccctcccgttgaccgatccgctgattaccctggaaagtctcgccagtggacatcttcccgctaccgtggcgctgacgggagcagtgattatcgctgtgctgtatgcgctggcgggaaagcgattattttgcagttgggtttgcccgctaaaccccgttaccgatttggctaactggatgcgcaggaaatttgacctgaaccagtcggcgacgattccacgccatatacggtatgtccttctggtggtggtgttaatcggttcggcgttgaccggcacgctgctgtgggaatggattaatcccgtgtcgctgttaggtcgtagtctgattatgggatttagtagcggcgcgttgctgattattgctttgtttttatttgatttattagtcgttgagcacggttggtgcggtcatatttgcccgatgggcgcgctgtatggcgtgctgggcagtaaaggcgtagtgaccgtgacggccaaaaaacgtgagaaatgtaatcgctgtatggattgttttcatgtttgcccggaaccgcatgtgctacgtgcgccggtgctggatgagcaaagcccggcgcaggtcactcaccgcgactgcatgacctgcggtcgctgcgtggatgtctgttctgaggatgtttttacaataacgatacacaacatcattcgggatgcatcgcggcggtaagcgaggaaatccccgggagcatagataacgatgtgactgggattttcgagcgcagccaacaaagaggcagctcgaaggatgaagtgtaaatgcgatggagttcgggagcgaaacaatgaaaagccatgacctgatgaaagcgctgtgtcaatggatggccacgcttgccctggtggtaagtggtgcggtttgggcggcaaacggagtggatctgagccagtcgccggaagtatccgggacgcaggaaggggcgattcgtatgccgaaagagcaggaacgtatgccgctaaattacgtcaaccagccgccgatgatcccgcacagcgtcgagggctaccaggtgacgaccaataccaaccgctgtctgcaatgccacggcgtggaaagttatcgtacgacgggcgcgccgcgtatcagtccgacgcactttatggacagcgacggtaaagtgtcgggcaacgtcgcgccgcgtcgttatttctgcctgcagtgccacgtaccgcagtctgataccgcgccgattatcgacaatacctttaccccctcgcaaggttacgggaaataagaggtcattatggaaaattctaaccgtaaacttggctggataaagcgcgtctggcgatggtggcgcagccccagccgcctggcgctggggacgctgctgttaatcggttttatcggcggcgtcatcttctggggcggcttcaataccggaatggaaaaggctaataccgaagagttttgtattagctgccatgaaatgcgcaacacggtgtatgaggagtatatggaaaccgtccactacaacaaccgtagtggcgttcgcgccacctgtcctgactgccatgtgccgcatgagtgggggccgaagatgatccgtaagatcaaagccagtaaagaactgtacgcgaaggtatttgggctgatagatacaccgcagaaatttgaagctcatcgcctgacaatggcacaaaatgagtggcggcgcatgaaagacaacaactcgcaggaatgccgtaactgccacaatttcgactttatggatctgaccgcgcaaaaaggcgtcgcggcgaaaatgcacgatcaggcggtaaaagatggacagacctgtatcgattgccacaaagggatcgcgcataaactgccggatatgcgtgatgttaaaccaggtttctgacaggacgttgatgagtgggaatgcttgaagccagagatctgtactgcgagcgggacgagaggacgctgtttcgcgggctgtcgttcaccgtggaggccggggagtgggtgcaggtcaccggcggcaacggcgccggaaaaaccaccctgctgcgcctgctgaccgggctggcgcgcccggacggcggggaggtgtactggcagggcgagcccctgcgccgcgtgcgcgacagcttccatcgcagcctgctgtggatagggcaccagccggggataaaaacccgcctgacggcgcgggagaacctgcactttttccaccccggtgacggcgcgcgtctcccggaggcgctggcgcaggccgggctggcgggatttgaggacgtgccggtcgctcagctctcggccgggcagcagcgccgggtggcgctggcccgcctgtggctgacccgcgccgcgctgtgggtgctcgacgagccgttcaccgccattgacgttaacggcgtggcgcgcctcacccggcggatggcggcgcacacggcgcagggcgggatggtcatcctcaccacccaccagccgctgccgggggccgcggacaccgtccgccgcctggcgctgaccggcgggggggccgggctgtgatgtggcgtgtcttctgtctcgagctgcgcgtggcgttccgccacggcgcggacatcgccggcccgctgtggttcttcctgatggtcatcaccctgtttccgttaagcgtcgggccgcagccgcagctgctggcgcgtatcgcgccgggcatcatccaggtggcggcgctgctggcctcgctgctggcgctggagcggctgtttcgcgacgacctgcaggacggcagcctggagcagctgatgctgctgccggtgccgctgccggcggtggtgctggcgaaggtgctggcccactgggcggtgaccggcctgccgctgatgatgctctccccgctggtggcgctgctgctggggatggacgtgtacggctggaaaatcatggcgctgacgctgctgctcggcacgccggcgctggggtttctcgccgcgccgggcgtcgggctgacggccggcctgcggcgcggcggcgtcctgctgggcattctggtgctgccgctgagtgtcccggtgctgattttcgccaccgcggcgatggacgcggcatcgatgcatttacccgttgacggctatctggcggtgctgggggcgctgctggcgggcagcgcgacgttaagcccgttcgccaccgcggcggcgctgcgcatcagtacgcagtagcgccccggcacgacggacattttactggtttcaggaggtcaggtgacgactatgtggaaaacccttcatcagctggcggcgccgccccggctgtatcagatttgcggcaggcttgtgccgtggctggcggcagccggcatcattgtgctggccacgggctgggtccggggctttggtttcgccccggcggactaccagcagggggagagctaccgcattatgtacctgcatgtcccggcggccatctggtcgatgggtatctatgcggcgatggcggtggcggcgttcaccgggctggtctggcagatgaaaatggccagccttgccgtcgcggcgatggcgccggtgggggcggtgtacaccttcatcgcgctggtcaccggcgcggcgtggggcaaaccgatgtggggcacctggtgggtgtgggacgcgcgtctgacctcggagctggtgctgctgtttctctatgccggggtcatcgccctgtggcacgcctttgacgaccgtaaaatggccgggcgcgcggcgggcattctggtgctggtcggcgtggtgaacctgccggttatccactattccgtcgagtggtggaacaccctgcaccagggctcgacgcggatgcagctgagtatcgacccggcgatgcgctcgccgctgcgctgggccatcgccggcttcctgctgctctttatgacgctggcgctgatgcggatgcgcaacctgattttactgatggaaaaacgccgcccgtgggtgagcgaactgatactgaaaagggggcaccggtgagtccggcattttcatcgtggagcgattttttcgccatgggcgggtacgccttttttgtctggctggcggtggcgatgaccgtggcgccgctggcgctgctggcgctgcacacggtgctgcagcgccgggccattctgcgcggcgtggcgcagcagcgggcgcgcgaggcgcggatgcgtgccgcacaggcgcaacaggaggccgcgtgaatctgcgacgtaaaaaccggctatgggtggtctgcgcggtgctggcgggcctggcgctgaccaccgccctggtcctgtacgcgctgcgcgcgaatatcgacctgttctatacccccggcgaaatcctctacggcaagcgcgagacgcagcagctgccggcggtgggccagcgcctgcgcgtcggcgggatggtgatgcccggcagcgtcaggcgcgacccggactcgctgaaggtgaacttcagcctctacgacgccgaagggtcggtgacggtgagctatgaggggatactgccggacctgttccgcgaggggcagggggtggtggtgcagggcaccctggagaagggcaaccacgtcctggcgcacgaggtgctggccaagcatgacgagaactacaccccgccggaagtggaaaaggcgatgcaggaaaaccaccgccgcccgcaacgcgctgataaggacacttcatcatgatgcctgaatacggccacgcactgctgtgcctggcgctcggcgtggcgctgctgctgtccgtttacccgctgtggggcgtggcgcgcggcgacgcgcggatgatggcgtcggccggggtgttcgcctggctgctgttcatctgcgtggcgggcgcgtttttcgtgctggtgcacgcctttgtggttaacgacttcaccgtggcctatgtcgccggcaactcgaacacgcagctgccggtgtggtaccgggtggccgccacctggggggcgcacgagggctcgctgctgctgtgggtgctgctgatgagcggctggaccctggcggtggcggtgttcagccggcaggtgccggcggatatcgtcgcccgggtgctggcggtgatggggatggtctgcgccggttttctggcgttcatcctgttcacctccggcccgtttgcccgcacgctgccggcctttccggtggaggggcgcgacctgaacccgctgctgcaggacccggggctgattttccacccgccgctgctgtacatgggctatgtcggcttctcggtggccttcgccttcgccatcgccgcgctgctgagcgggcgtctggacagcgcgttcacccgttttgcccgcccgtggacgctggcggcgtgggtgttcctgacgctgggcatcgtgctcggctcggcgtgggcctactacgagctgggctggggcggctggtggttctgggacccggtggagaacgcctcctttatgccgtggctggcgggcaccgccctgctgcactcgctggcggtcaccgaacagcgcgccggctttaaggcgtggacgctgctgttgtccatctgcgccttctcgctgtgtctgctgggcaccttcctggtgcgctccggggtgctggtgtcggtgcacgccttcgcctccgacccggcgcgcggaatgtttatcctcgcctttatggtgctggtcaccggcggctcgctgctgctgttcgccgtgcgcgggcacagggtgcgttcgcgggtgaacaacgcgctgtggtcgcgtgagtcgctgctgctcggcaacaacgtcctgctgatggccgccatgctggtggtgctgctgggtaccctgctgccgctggtgcacaaacagctggggctgggcagcatttcggtgggggagccgttctttaacaccatgttcacctggctgatggtcccctttgccctgctgctgggggtggggccactggtgcgctggggccgggaccggccgcgtaacatcaggaaactgctgctcaccgccctggtctccaccctggtgctgtcggtacttttgccatggctgctggaagatagaatcatcgccatgacggcggtggggatggcgatggcctgctggattgcggtgctggcggtggccgaagccgtacagcgcgtgtcccgcggcacgaaaacctctctcagctactggggaatggtggcggcgcacctcgggctggcggtgacgattaccggtatcgccttcagccagaattacagcgtggagcgtgacgtgcggatgcgggcgggcgacagcgtgaccattcacgactaccgcttcaccttccgggaggtgcgggacatcaccgggcccaactaccgcggcggggtggccctcatcggggtgacgcgccacggcgagccggaggcggtgctgcacgcggagaaacggctctacaacaccagccggatggtgatgaccgaggcggcgattgacggcgggctgacccgcgacctgtacgccgcgctcggggaggagctggacaacggcgcgtgggccgtgcgcctgtactacaaaccgtttgtccgctggatatgggccggggggctgctgatggcgctgggcgggctgctgtgcctggcggacccgcgctaccgccgccgtaaaccattgccggaggccggatgaaacgcaacgtactgttattaccgctgctgatttttctgctgattgccgcggcgctgctgtggcagctggcgcgcaacgcgcagggggatgacccgacgaatctcgaatcggcgctgaccggaaagccggtgccggcgtttcgcctggaatcgctggagacgccgggtcagtactatcaggcggaggtgctgacgcaggggaaaccggtgctgcttaacgtctgggccacctggtgcccgacctgccgcgccgagcatcagtacctgaaccggctggccgcgcagggtatccgggtggtggggctgaactataaggacgaccgggcgaaggcggtggcctggttaaaggaactgggcaacccgtatgcgctgagtttatcggacagcgacgggatgctggggctggacctgggcgtgtacggcgcgccggaaaccttcctcatcgacggcagggggattatccgctaccgccatgcgggcgatttgaatgcccgggtatgggaaagtgaactgaaaccgctgtgggacagatacagccgggaggcggcgcaatgagactgttaccgggcatggtgatgctgatgctggcgctggttatctccgggtcagcgcgggcgaccaccgacgtgatgccgtttaaagatgaagcgcaggagcagcagttccgccagctcacggagcagctgcgctgcccgaaatgccagaacaacagcattgcggactcgaacgcgatgatagccaccgacatgcgccgcagggtgtatgacctgatgcaggaggggaagagccgccaggaaatcatcgattacatggtggcgcgctacggcaacttcgtcacctacgacccgccgctgaccccgctgacggtgctgctgtgggtgctgccgctggccgccatcgtggcgggcgggtggataatcgtcgcccggacgcgccggcgggtgcgcctgcgccgggagccgctgccggcggacaccccggtttgcggcgcgcgcgccgggtggggcgtttacgtgccgggggccgtcattgcgctggcggtcggcgccggcagctacgccctgaccggcagctatccgcaggtgagggcctggcagcaggcaacggcgcagacgcccgggctgctggcgcgggcgctggacccgcaggcgcagccgctgaatgaggaggagatggcgcggctggcgctggggctgcgcacccgcctgcagaatgatgccggcaatgttgagggctggctcatgctggggcgcaccggtatggtactgggtaatgccggtaccgccaccggggcgtatgcgaacgcttaccgtctggacccggaaaaccgcgatgcggcgctgggctacgcggaggcgctgacgcgctcgtccgacccggaggataaccgccgcggcggggaactgctgcgtcagctggtgagccgcgaccacacggatatccgggtgttaagcctgtatgcgttcagcgcctttgagcagcagcgctttggcgaggcggtggcggcctgggagatgatgctgaagctgctgccggcgggtgacgcccggcgggcggtgatagagcgcagtatccggctggcgcaggagaaataagaccctgacggcccggtggcgtggcgccaccgggcctggcttgttactgcattccgcgtgtttgtaaaaatagaatggtcgccgcgacgcgcgagcgcacgtttagcttgcgaagtagattacgaatgtgcaccttaaccgtctgctcagaaatattcagtactgacgcaatctgtttgttagaaagcccctgcgccagctcatgcaagacatctaactctcgttcggtcaggatactaaagggatcttcctgcgcgccaaaccgttcacgctcacgcagatattcattgacccgatcgctaaagactttaccgccgttagcgcctttgcgaatggcctccagcagcacttccggatcgctatctttgagcagataaccgtcggcgccggcgtcgatcagcgcgtagatgtcgctggcggaatccgagacggtaagaataataatttgcgccgtcacaccatcccggcgtagcgcgttcagggtatctaacccgctcagacctttcatattcagatccagcaggatcagatcgggctcaatgcgattcgccagatcgatcgcactcgccccgtcacccgcttcggcaacgacataaaaagccgggtccagttccagtaattgacgaatacctcgccgcataagtggatggtcgtccacaataagcacctgaaaaggtgttacttcaggcatgctatatctcctgagttttattagaatgattattgttttcagcgcggaaatcgtccagatttgccacattgtcaagcgcgtaaattttaccttaattagtgcatgggtaagtagtaaaacctgtgacaggcgagtcattagctgaacgatagaaaggataaaacaacctgttgtgagagaaaacagaatactccctgaagttgaatactggtctggacgcttttttcggacaatgtgacataacagaagtgtggcatatgtagctgcgcccttgcgtccgtaagtccagactatctttactggcaggaaattccttattaaaagtcatagcgtctaaagattttcattattaacaaattattttaattgaatttatttatggttttattaatgccaatgaaatacatctgagcagaacgaataaaccgcgacatctgttaaattaaatattaagtcaatagcagaggtatttttatgcgataaagagattctgacgatattcttatcataaatgaaaatgtggtcaggaatgagcgtcattcacttataacttatcctggatgtgcctgaacaacactcgcggcgttttgagcacccgttggggcgactcaaggggagaacgtagtgtggatgctatatcagccgtttctgtgagcgtaagcgtggcgtagaaaattttaaatatgttagccggttaaaaataactattgacattgaaatggtggtggagtgtatatgaagagaatatttatatatctattattaccttgtgcattcgcatgttctgctaatgataatgtttttttggcaagggcaacaagcatcagatctcttttgctgcgggagaaagtataagaagaggaggggttgagcacttatatacggcttttctgacatacagtgaacccagcgattttttctttttacaggcaagaaataatctggagttaggaggatttaaggctaagggtagcgatgattgcagtaaacattctggcagcgttccctgtaataaatataaccagggcgtattgggtatctcgaaggatgtggcgctggttcatttcgctggtatctataccggtattggtctgggggcttatataaaatctaagtcgcgagatgatatgcgtgtcaattctgcatttacctttggagaaaaagcgtttcttggctggaactttggggctttttctacagaagcttatatccggcatttctcgaatggatcacttacggataaaaattcagggcataattttgtaggtgcttcaattagttataatttttgaagttgaataacaattagcgagttgctggctgaaggagtaattaatcaccgtacgttgtctacaaaacgtgttgtgaatagccgatcgttatcgaccctatggcgacagggaggctaattgttagcgacaaaggcgtggtaggccgtttaccttaccagaacgttttattattgctgcgacagattgcttactcatttacctgccactgcaaacattttttccagtatagggtgtagatgcgctttttctgttttagtacaaacatggtttacgttagttgcctgcattgactttactgtgaccactgcacaggaaagatgtccaatcagttcatgcaaaatcagttcatgcaaaataacgtctctggcatcagctaactttttaattgtaggcataaaaaaaccagccctgacaggctggttttcaaggggaattttggtcggcagcttcatccgcagcatctgcggagagcagcgcaggtacggcgaccacaaaagccggggaggcatcagccagcgcggcgtcggctgacacagccagaacggcggcagccgcctcgtcatcagcatcgtaggcatccacccacgccgccgcatctgataccagcgcatcactggcagcgcaaagcagagctgcagccggagaatcggcaaccagagctgaagaggccgcgaaacgggccgaggatatcgcagacgtgatttccctggaagatgcaagcctgacgaaaaaaggtatcgttaaattaagcagtgccacggacagtgacagcgaagcgctggcggccacaccaaaggcggtaaaaaccgttatgggtgaggtacggaccaaagcgccgctggacagcccggcattcactggaacgccgaccacaccgacgccgccaggcgatgctaaagggcttcagacaacaaacgcggagtttgtccgcaaactgattgccgcgctggttggttccgtactggagccactggacaccctgcaggaactggctgacgcgttgggaaatgatccgaactttgccaccacggtactgaataaactggcgggcaagcagccgctggacgaaaccctgacggcgctgtcaggaaaaagcgttgacggtcttatcgaatacgttggtttgcgagaaaccataagtcgtgccgccgatgcattacaaaaatcacagaatggcggcgatattccggacaaggatttgtttgtgcgtcgtatcggtgccgcgcgagcgtttgatggcgcagttattatcggctgtgatgataatccgtggacgacggcggagtttatcgtctggctggagtctcagggcgcattcaatcacccttactggatgtgtcgtggctcctggtcttacgcttataacaaaatcatcacggatactggctgcggtaatatctgtctcgctggcgcagtgattgaggtaatgggagtgcgtggcgcgatgactattcgggtgacaacgtcccattcagtatctggttggtgatacgtgggtgacagccccaagtgtataagaaggaataattatgacagcggaaaaaaaataaaaagaacaaacagtttttaaatattaaaaatttcattccgtatgcaccggaaccagatgacacattattcgccgatgcggcgtatcttaaatcagaggatggtcaggactggtatgggtgccagcaattattttcagcagacacgctgaaaattacctacgacgataacgatgttattacgtgtattacgcgtgatgtttccgggctgtggcctgctggccagagcgttgcagagttgcctgatacggatgaaaaccgtcgcgctgatattcatgctgctggcagtttaaagacggtaaagtcgttcaaagggtttattcgccggaagagctgcgcaggcaggcagaatcgaaaattgaacgcccgggcgttgataccggatgatctggtcatcgtggaaagcgaccctgaaaaaatcgacactttagctgtaaaatgacagtcccgccatccggtcatcataacggatttttcttctgcaccttctgaagcccgccatgtcaggacgaccatgaatccgccgataaccttattgtgaaattaagaccaggaagagatgatgtctgccggacagatactatatgtaaatttataaaggttttttgttatgccctttcatattggaagcggatgtcttcccgccaccatcagtaatcgccgcatttatcgtattgcctggtctgataccccccctgaaatgagttcctgggaaaaaatgaaggaatttttttgctcaacgcaccagactgaagcgctggagtgcatctggacgatttgtcacccgccggccggaacgacgcgggaggatgtgatcaacagatttgaactgctcaggacgctcgcgtatgccggatgggaggaaagcattcattccggccagcacggggaaaattacttctgtattctggatgaagacagtcaggagatattgtcagtcacccttgatgatgccgggaactataccgtaaattgccaggggtacagtgaaacacatcgcctcaccctggacacagcacagggtgaggagggcacaggacacgcggaaggggcatccgggacattcaggacatccttcctccctgccacaacggctccacagacgccagcagagtatgatgctgtctggtcagcgtggagaagggctgcacccgcagaagagtcacgcggccgtgcagcagcggtacagaaaatgcgtgcctgcctgaataatggcaatgcagtgcttaacgtgggagaatcaggtcttaccaccttgccagactgtttacccgcgcatattaccacactggttattcctgataataatctgaccagcctgccggcgctgccgccagaactgcggacgctggaggtctctggtaaccagctgactagcctgccggtgctgccgccaggactactggaactgtcgatctttagtaacccgctgacccacctgccggcgctgccgtcaggactatgtaagctgtggatctttggtaatcaactgaccagcctgccggtgttgccgccagggctacaggagctgtcggtatctgataaccaactggccagcctgccggcgctgccgtcagaattatgtaagctgtgggcctataataaccagctgaccagcctgccgacgttgccgtcagggctacaggagctgtcggtatctgataaccaactggccagcttgccgacgctgccgtcagaattatataagctgtgggcctataataatcggctgaccagcctgccggcgttgccgtcaggactgaaggagctgattgtatctggtaaccggctgaccagtctgccggtgctgccgtcagaactgaaggagctgatggtatctggtaaccggctgaccagcctgccgatgctgccgtcaggactactgtcgctgtcggtctatcgtaaccagctgacccgcctgccggaaagtctcattcatctgtcttcagagacaaccgtaaatctggaagggaacccactgtctgaacgtactttgcaggcgctgcgggagatcaccagcgcgcctggctattcaggccccataatacgattcgatatggcgggagcctccgccccccgggaaactcgggcactgcacctggcggccgctgactggctggtgcctgcccgggagggggaaccggctcctgcagacagatggcatatgttcggacaggaagataacgccgacgccttcagcctcttcctggacagactgagtgagacggaaaacttcataaaggacgcggggtttaaggcacagatatcgtcctggctggcacaactggctgaagatgaggcgttgagagcaaacacctttgctatggcaacagaggcaacctcaagctgcgaggaccgggtcacattttttttgcaccagatgaagaacgtacagctggtacataatgcagaaaaagggcaatacgataacgatctcgcggcgctggttgccacggggcgtgagatgttccgtctgggaaaactggaacagattgcccgggaaaaggtcagaacgctggctctcgttgatgaaattgaggtctggctggcgtatcagaataagctgaagaaatcactcgggctgaccagcgtgacgtcagaaatgcgtttctttgacgtatccggcgtgacggttacagaccttcaggacgcggagcttcaggtgaaagccgctgaaaaaagcgagttcagggagtggatactgcagtgggggccgttacacagagtgctggagcgcaaagcgccgaaacgcgttaacgcgcttcgtgaaaagcaaatatcggattatgaggaaacgtaccggatgctgtctgacacagagctgagaccgtctgggctggtcggtaataccgatgcagagcgcactatcggagcaagagcgatggagagcgcgaaaaagacatttttggatggcctgcgacctcttgtggaggagatgctggggagctatctgaacgttcagtggcgtcgtaactgatgcaccaggtgaatgaggtgcggtgcgacaaagatattcccggacgaacaacatcagacagtacggatgatgtacaggtgaaataggggagacttcttcagtcagggcgcggcgcaactttttcgatgataacgcgccgcgcgccggtagcgagaagccgatggaagtactggatcacctgaatgcaaagaagggcaggggaaagctgtactttgccggggagggtatccagcaacagtgggctatgaagagaaacatactgtcatcccgatataccacccgctatgaagacctgcttcaggttaagtgacaggtttactctgattttcaaatttctgatgtgatggtgtgccgcagccacattgtatgcaagaacgggctgcggcaaactggcgatcgttcgatagtgcgtgtattgaatagttaccagtcgtggcggattctactggttaaggatgactaatcaatgtatttaagtcatctgttcaacttttcgcgttggagggagcttgaagtcaatttgcagtgaccttcgatagctatttcaccatcatttcaccatttgcaaattggatatataaaaaaaccagccctggcaggctggcttttaaggggaattttggtcggcacgagaggatttgaacctccgacccccgacaccccatgacggtgcgctaccaggctgcgctacgtgccgacttgtgggtgctaatactacctctttccaatgcgaatgcaaggggaaacggtgctaactgatttataattaatcagttagcgataaaacgtttctcttctgttagcacttgcagcagcagactgagctgcggcttctgatctttgatcttctcgccgtgtaagtcataggtctgataatgaccgttattattgagcaccagggtcatttgcggcgtcgtgattgccagcgtactgccgtctgccgccgttacccagttatgacgacgtggaacggtaaagatgtcctggccctgtgaatattcgttcgctggcgtgctgacatgtaacaggcgttgcatcaacgtggtcatcacatcggtatgatcggtaagcacattaatacgctgcgcaggcgtccccggccagtggatcaccagcggtacttgcagatgaccttgcgaccagtcgaagcgattttcttccggcgtcaacggtatgccgcgtcctgcggtaatgatcacgacagtattgtcgaatttaccggcctctcgcagcgcgttcagaacccgattgatttgcgcatccacgtcgctggcggcactggcgtaacgcttaacaaaatttttctggttactgtcatcaatgttagtaccgttaaacgatatccatgagaaccagcggttatcttcctgtgcgtagcgcccaagccagtctatccactggctggccgtttgcgcatcagactgcgtttgcgctgccggcatcgagaaatcggacagtaatgcctgacgataaagcgggctggcgaagccatccgaagaaaacagtcccagttggtagccttgctgattcaacgcggtaatgagcgccgcaggcgttctggtggataacacgccatccatatagcctggcgatatgccatagaacaggccgaaaataccgttatcagtggtattccctgaactcatatgacgggtgaagtcgatgttttgctcggcaaatgtagccagctccggcatctgcttctcaaagcgagaatagttcaggccgtctacggtaatgagcagcacattctgaccggtgcccatatcgcgatagtgcaaattgctgagcgggtactgaacggagaccgcttccggattgccttgctctaccagacggcgctgatattcctgcgcatccagcagaccgtgtttttcaagaaaacgtcgcgccgtcatcggataagagagcggcaggtttgcccgctgcatggtaatcggccggtaaaaattagcgtctgcccagatgtagataagatgcgatgcgataaaggagacgaaaaagaatgccgcaagcggccttgcgaaatggcggcggcgcgtgagactgcgcagcttttgccaactccatgtcgcaaatagcatctcaatcaataagataactggcacgctaataaacataagctgccagtcgcgcgccatttcgttctggtcagggttgatgaccagttcccagacaatggggttaagatgcaggtgaaaacgggtaaagacttcgctgtcgataagcaacaacgtcatacccgcggtcgccagaatggctgataaaaaccgcatcagccgctgggacatcacgataaacgtgagcggaaaaagaataagcaaataggtggcgaacaccagaaagctaaagtgcccgacaatgctcaggtaggagtatatgcgacccgcaagcgttgtcggccagtcggcgacaaacaggtaacggctgccgagcaacgtagccaacagtatattgaacagagcgaaccagtgcccccagctaaccatctgggagactttttcacggtagcgctgacgatgagttaccatacctgtcgcttgtttctccggagtcggctttttagtgcgcgttgtcttcgctaatcgaagactgcaaggcgcgggcaaaagagttcgcaatcgcctggcgttgagccggcgccacgctggtgttgataaggttggtgaccatatttcccagtaccatcagggaaagatcggtcggcgccttatgtttttccagtacactgagcagttcgctcagcagttgttcaacatgttcatcactatagcgggagagttgtggcataaatcaaaatctgtttgttcatgaaagggcaacatattaccgtagcaacagttttttttctgcatttttatcccctaaatcattcgcgttacggataacgcctgaaatgacagggcgattgcttgcgtcttccggcaggcggtggttgaataccgcccggtcttaaaggagagtttatcatgagtctggatatcaaccagattgccctgcaccagcttatcaagcgcgatgagcaaaatcttgagctggtcttgcgcgattcattgctggagccgacaaccaccgttgtcgagatggtggctgaactgcatcgggtctatagcgccaagaataaggcgtatggcctgtttaatgaagagagtgaactggcgcaagcgctgcggttgcaacgtcagggggaagaagattttcttgcctttagccgggcggcgaccggacgcctgcgtgacgaactggcgaaatatccctttgcggacggcggcattgtattgttctgccattatcgttacctggcggtggagtatctgctggttacggtactgaacaacctgagcagtatgcgggtcaatgaaaatctggacattaacccgacgcattatcttgatatcaaccatgcggatatcgtggcgcgtatcgatcttaccgagtgggaaactaatccgcaatcgacccgctacctgacgttcctgaaaggtcgggtagggcgcaaggtcgctgacttctttatggatttcctcggcgccagcgaagggttgaacgccaaagcgcagaatcgcggcctgttgcaggcagtggatgatttcaccgcagaagcgcagttggataaagcagaacgtcagaacgtgcgtcagcaggtgtacagctactgcaacgagcagttacaagccggggaagagattgagctggaatcgctgtctaaagagctttccggcgtcagtgaagtcagcttcagcgaatttaccgccgaaaaaggctatgagctggaagagagcttcccggcagatcgcagtacgctacgccagttaaccaaatatgccggcagcggcggcgggttaacgattaactttgatgcgatgctactgggcgagcggattttctgggacccggcgaccgataccctgactatcaaagggacgccgccgaatttgcgcgatcagttgcagcgacgcacgtcgggcgggaaataaaggcatacgacataaaaggacgccgtagtgagtaaaggaatacgtcagaggccgcctgttaatttcagtttatttcggcaggttttgtatgcgcacattgtcgcatttttgatgatgttgatgctcggcatggtgttcaccgttctctcgttggtactgttttatacttatggcgccaactggttactgagcttgttcatatgcccgctgttcttgttaagtggtttattcattactggatttgcttttaaatcaacctggtccagcatacgttactattacgacaaggggcagttgaaacggtatggactcaatcttgatgcaactttgacgcataaagagaaggtggaaatacgcatcgataatgcaaagcgtcaagtgcgtgtagatgaactggaactccatgtcttatttgattttcagtttgatagcaagacatggagctgcggcgacttactgaccaatgaaaaggtatttgatgcgttgaatgatgggcaaacgataccaatacgaattttgccatggaaaccggaaagtgccagcgttcgtcaacgggcattattcaatcggcttaaaggtatgaataccgcggcggaaactacagatcctcgattaggggaggcgctaattgaatgtggcgaggtgtaagaaagcagaaaagcaaagtgggttctcgttgctctgcatgtcgtcaaattcaattaaacgcataaaaaaaccccgccggggcggggtttttcttcaacttccaggcgattacgcgcgaacgaagtcgatgtgagtcagcttcggtttgtaagcgtgacgctgtacagcctgagctttaacttttacttctttaccgtcaacaacgagggtcagaacttcgctgtagaattcagctttagcttgcatgttcatcacctggtcgtggtccagttcgatagcaatcggggcttcagaaccgccgtagatgattgccgggaacttgttagcggcgcgcaggcggcggctcgcacccttaccctgctctttacgtacttctgcgttgatagtaaacatttaaatctctctttaataattcctgctacaggcgacccagcaacaggtaagtgatctgctttgcgtatgcaaaggcgggcgggattctatactcaaatcgccgttacatcaatgaaaagtacaattaaccacgtaattcgtgcgcccggcggaagcggccttcatagtcgaacactttttcacgcacctgccagtactggcctttcatccgcgcgaccacaaaatcgggatgccgcaacagcgcctgctgcgcgacaatatccgccgccgtgatccagcgtaaaggaacgccgggcgtgcgcgtatgcgggcgaataaatagctgttcgaaagcggtacgctgggcgggcgtgtgcaagcggaagcgctcactgacatccgcgccgtcctcgtcatagtaagtgattttcagccattcgcctttctcatcctgcccatgctgcatcgtcattccgctacagcgcaggactaacgcatccttgagcctgagcgccgcttttaacatatcgtccgggtcgaccagaatggcgtcacattcccggcagcgtcgggcggcaatatcgttttcggcattacactgcgggcagtttttgaagcgaaagcgaaaatcgcactgctcgcgatggccgtcgtcatcctcaaaccagccctggcagcgacggccaaagtgttcaatcagcgtgccgtcggcagtggttttcccccagaaggtgttggcaaagccgcaggccgggcaaaatacctggacagggacgttatcgctttttcccttcgggctaccgacctccggggcatacaggtcgtgcgggttgcctgcgtaatcaagaatcaggcaatcggtctttcccggcgcaaggcgcagaccacgcccgacaatttgttggtaaagactaactgactccgtgggacgtagaatcgcgatgagatcaacgtgtggggcgtcaaagccggtggtcagtaccgagacgttaaccagatagcgaaaacgctgcgccttgaaattatcaatcagcgcgtcgcgctcgggccctggcgtatcgccggtaatcagcgccgcgtcgtccgccggaagcagaccgacaatctctttcgcatgttcgaccgtggcggcgaaaatcatcacgcctttgcgcgtttgcgcaaattccataatctggctgatgatgtgcggcgtaatccgctgctgctttttcagctcgcggttcaggtcggcttcgctgaacagcccattgctttgggcctgcaggcggctgaaatcgtattggaccactggcatatcaagccgctcaggcggcgtcagatagccgtgtttaatcatatagcgcagcggcagttcataaatacagtcgcgaaacagagcgttgtcgttgccgcgcaccataccgtgataatgaaattgataaatccagccttttccgaggcgaaaaggcgtggcggtgagtccaagcagacgtaagtgaggattaactttactcaggtgagtgaggatttgctgatactgactgtcttcatcgtcaccgatgcggtggcattcatcgacaatcaacagcgaaaactcctcctggaaggcgtcaagattacgcgccaccgactgtacgctgccgaacacgactttgccctgactctctttacgtttgagtccggcggcgaaaatatccgcttccagccccagcgcgcaatatttggcgtggttctgcgcgaccagctctttcacatgcgccagcaccagtacccgtccgcgggcgacgcgcgccagttcggcgatcaccaggcttttacctgcgccggtcggcagaacaatcacggcgggcgtacggtggcggcgaaagtggctgagcgtggcgtctacggcttcttgctggtaggggcggagtgtaaaaatcatggtctcactacgttaaacggttccgggaatagtatgccatgaatcatttcccttgagggatatagttagcccgctatactgagcggatagcaattcccttttttcgggtagaatgcccgatttccgtattattacaggctaaatcacacacatgcgacttgataaatttatcgctcagcagcttggcgtcagccgcgctattgccgggcgtgaaattcgtggtaaccgcgttaccgtcgatggcgacatcattaaaaatgcggccttcaaactgctctcggaacatgcggttgcgtatgacggcaatcccttagcgcagcaacacgggccacgctattttatgcttaacaagccgcagggatacgtttgttcaaccgatgatcccgatcatccaacggtgctgtatttcctggatgagccggtggcgtataagctgcatgccgcaggacgtctggatatcgatactaccggtctggtgttaatgacagatgacggtcagtggtcgcaccgcattacgtcgccgcgccatcactgtgaaaaaacctatctggtgaccctggagtcgccggtggccgacgatacggcagcgcaatttgcgaaaggcgtgcagttgcataatgaaaaagatctcactaaacccgctacgctggaggtgataacacctgtgcaggtccgtctgaccatcagcgaaggccgttatcatcaggtgaagcggatgtttgccgcagtaggcaatcgcgttgtggaactgcaccgcgaacggattggcgccattacgctggatgagaatctggctcccggcgagtaccgcccgttgactgaagaagaaatcgccagcgtcggctaactatctcgttaaattcaggagttcgatgtgaccacccggcagcactcttcctttgccattgtctttattcttggcctgttggccatgttaatgccgctgtcgattgatatgtatcttccagcgctgccggtgatttctgcgcaattcggcgtgcctgccggtagcgcgcagatgacgctcagcacctatattctggggtttgcgctgggtcagcttatctatggaccgatggcggatagcctcgggcgtaagccggtcatcctgggcgggacgctggtatttgccgctgcggcggtcgcctgtgcgttggcgcagactatcgatcaactgatcgtgatgcgtttctttcacggtttggtggctgcggcggcaagcgtcgtcatcaatgcgctgatgcgggatatttatccaaaggaagagttttcgcgcatgatgtcatttgtcatgctggtcactacgatagcgccgttaatggcgcccattgttggcggctgggtgttggtatggttaagctggcactatatcttctggatactggctattgcggcgattctggcgtcagtcatgatctttgctttgattaaagagacgctgcccgttgagcggcgtcagccttttcatattcgtaccacaataggtaactttgccgcgttgtttcgccacaaacgcgtactgagctatatgctggcgagcgggttcagttttgccggtatgttctcttttttgagcgcggggccgtttgtctatatcgaaattaatcatgttccgccgcaggatttcggctactacttcgcgttgaacatcgtatttctgtttgtgatgacgattatcaacagccgttttgtcagacgggtaggggcgctaaacatgtttcgggccgggctatggattcagtttgcgatggcggtgtggatggttttcagcgcgctgatgggcattggattctgggcgctggtggttggcgttgcggcgtttgtcggctgtgtgtcgatggtttcgtccaatgcgatggcggtcattttggatgagtttccgcatatggccggaacggcgtcttcgttggcgggcactttccgctttggtattggcgctatcgtcggcgcgttgctgtcgctggctacctttaacagtgcgtggccgatgatctggtcgattgcgctttgcgccgcctgttccattctgttttatctctacgccagccgtcccaaaaaacggtgacgggcgcggtgtccctcaatggcgccgaagaatgcgcaggcggcgttggggggcgctatccgctacacgatggcaaagccaaacggctttcatagttgatgtatatcaattaccaattcatcattttcctcctttatgtttattttatgtaaaatccatttatgtaaaaagtcacatcattgtagttaaaaaggttgagttagatcgcagaaacgggtacatatagcccgccgctatctccgcgtcggtaaaactattttaactcccgcttgctgtagagccactgacggagagaagggcgttagcaatctgtttaaggacgggttgtcaatgatgtgttaatataaatgtaagtaaattgtgaagtaattgtgcttccggggaaagaaagtgaatacattacagctctcaattgttcaccgtctgccgcaaaactatcgctggtcggcgggttttgcggggtcaaaggttgaaccgattccgcaaaacgggcagagcaccgagaatagtctggtggcgcttaaactgttgagtccggcaggcgatagcgcgtggtcagtgatgcataagctcagccaggcgctaagcgatattgaagttccttgctccgtgctggagtgcgaaggggaaccgtgcctgttcgttaatcgtcaggatgagtttgccgccacctgtcggctgaaaaatttcggcgtggcgatagcggaacctttttctaacaataatcctttttaggcgtcagcttaacgcgagtagctgacgcgtatacgcttgttgcggtgcggtaaacacgcgctcgcattgcccctgttcaaccacctccccctgtcgcagcacgataacctgatggcacagcgcgcgtactacatgcagatcgtggctaatgaagatataggccagacggtgcttttgctggagcgatttcaggagggcaagaatctgcgcctgaacggttttatccagcgatgaggtcggttcatccagaataataagcgacggttttaaaatcagcgccctggcgacggcgatacgttgacgctggccgccggaaaactcagcggggtaacgatgccgcgtttccgggtccaggccgacttccatcatgaccgctttcacctgctgttcgcgctgcgcgcctgaaagcgtaggctggtggacgcgcaggccttcttcgataatttgcaatacgtttaaacgcgggtttagcgatgagttcgggtcctggaatacgacctggatacggtggcgaacaggtaaaagctggcggcggtttaacgtatccagcgattgaccgtcaaacacgatgcggccttcggagcggataagccgtaacagcgccagaccggtggtgctttttcccgatcctgactcgccgaccagacccagcgtttcgcctggatgcagggtgaaactgatattgttaaccaccacattatgatccacgacgcgcttcagaatgcctttgcggattgggaaggcgacgcgcagcttgtccacttccagcaacggcgcctgcccggcggggagcggaaccggatcgccagtgggttcgctgttgagtagtttttgcgtgtacggatgggtcggcgcggagagcagcgtgtcggcgcgttggttctctacgcacttgccgtgttgcattaccgccactgaatccgccagtttttttacaatgctgaggttatgggtgataaacagcaatcccatattgagctcacgctggagttcccgcagtagagataagatctgcgcctgtacggagacgtcgagggcggtggtcggctcatcggcgatcagtaattccggccgtgttaacagcgccatggctatcatgacgcgctggcgttcgccgccggaaagctgatgcggataatcgcgcagacgctggctcgcctggcggataccgacccgatccagacaaccgatcatctccgcccttgccgcctcccgacgcattccccgatggagcgacagcacttcatagagctgtttttccagcgtatgcagtgggttaagtgaaaccatcggttcctgaaaaatcatggcgattttattgccgcgtacgccgcgtagcgtctgctcgctggcatgaagcaatgattcgccgtgaaagcgaatatcgccggagaggtagacggcgggaggggtaggcaaaagacgcagaatggaaagcgccgtcacgctttttcctgatcctgactcgccgaccagcgccagcgtttccccggcgttcacctgtaacgaaatggcgttaacgacagggcgcacgtgctgttgctgacggaaacctaccgataaattttcaatcgcaagcaatggagatgtcatcttataccgccttagcaggatcaaaggcgtcgcgtaccgcttcgccgataaaaatcagcagcgatagcagaatggcgacagacagaaaggcggcgatccccagccagggagcctgtaagttgtttttcccctgtaaaagaagttcgccgagagaaggggagccaagcggcagaccgaatcccagaaaatccagcgacgtcagggtggtgatggaactacataaaatgaacggtaaaaatgtcagggtagcgaccatcgcattaggcaacatatggcgcaggataatgtcacgatcgctgacgccaagcgcctgcgcggcgcggatatagtcaaaattgcgggtccgtaaaaactcggcgcgcaccacgcccaccagactcatccagccaaacagcacggttatggccagcagccaccagaagttaggctgcactacgctggaaagtaaaataatcagaaacagggtcggcatccccgaccagacttcgatgagacgttgcccccataaatcgactttgccgccataatagccctgtagcgcgcccgccagtacacccatgacgctggagcaaatcgttaacatcaggccaaataaaatagaaatgcgggtgccgtacaggatgcgggcgaaaacgtcgccgccattcgcatcggtgcccagccagtttttcgccgaaggcggggaggggaaaggctgcgtggtggcaaaattaatggtattggcgccaaagcgtacgggggcccacaacacccagccccgattctcaagctgccgttgtagccaggggtcctgatagtctgccgttgtcgccagcgggccgccgaaatcgcgctcgctgtaattttttaccagcggaaaataccactggccttcatagcgcaccagcaatggcttatcgttagcaatcagttccgcgcataagctcaggctgaacactaccaggaaaatccatagtgaccagtagccccggcgattatggcggaaacgcgcccagcgggcctgattgaccgggcttaatcgcggcattatcgtccctcaaaatcaatgcgtggatcgaccagcgtatagctgatatcgctcaggatattcagtaataagccaatcagggtaaagatataaagcgtgccgaacatcaccggatagtcgcgcgaaacggttgcttcataacccagcagccccaggccgttgagcgagaacatgacttcaattagcaacgagccggtgaaaaacatactgataaaagtggcgggaaacccggcgatcaccagcagcatggcgttacgaaaaacatgtttccagagaatgtttttttcactcacgcctttagcgcgagcggtaacgacatactgtttacgcacctcgtcgagaaacgaatttttcgtcagcatcgtcagggcggcaaaaccgccgatgacggtcgccaacaccggcagcgtaatatgccacaaataatcggtgattttctggtaccacggtaacgtgtcaaagttggcggagaccaggccacgtagcggaaagatatcgtagtagctgccgccggcaaaaaagacgattaataaaatagcgaacagaaaggcggggatcgcataaccaataatgataaacgcgctgctccacacatcaaagcgactgccgttatggacggctttgcgaatccccagcgggatagacaccagataaataatcagcgtgctccataatcccagggtaatggagacgggaaggctatctttgatcagcgttagtacggatgcgctgcgaaacagactgtcgccgaagtcaaaagagagatagtcccgtagcatcttgaaataacgctcatgcagcggtttgtcgaagccgtagcgatgggtgatctccgtgatcacctccggatcgagtccccggccgccgcgataatggctgtcgctgatattgccgacgccggtttgcgcatgactggcgcgaacgccttcgccgctggcgccgggcaacgcgccgccctgaccaaattcaatcgcggcaatagcctgatcgacagggccgccgggagcgatctgcacgataaaaaagttaatggtaataatggcccatagcgtggggatcaccagtaacagacggcggataagataggcacccattgattcttactacctcctggctgccggtagcttggcggctttgttgacatcataccaccaggtatctaacccgatggtatataccgggcgaatcgccggatgggagaatttatcccaccaggcgagcctgtcttgcgccatataccacatcggcagcatgtaatagttccaggtcagcacgcgatccagcgcccgtcccagcggcaccagtttcgctttatcaccctgcgctgcgataatttgcgcgatcagcttatccaccaccgggctttgtacgccgggagcgttataactggagtcaatgtattccgacgcccatgagatttgtagatcggagctgggccagggcatcgcccgccatagcctcggcatcatgtcatagtcgcggctacgcatccggttggtgagttgagaattatcaacctgacggatagtcatcgtaatgcccagacgctgaagattatgctggaagggcagaacccactggctattactgctggcaggaaggagaagttcaaacgtcagaggcttaccggtgacgctattgacccgttgctgtccgttgatcacccatccggcctgcgtcaacaaggcgtcagctttaagaagattttcgcgatcgtagccgtcgccgttagagaccggcggctgatagatctgagtgaagacttcaggaggaagatcttttttcatcggcgcgagtaataccagttcgtcggcgtcaggataatttctggcggcgtactcggtattctggaagtaactgttggttcggctccaggcattatagaacagcgctttattcatccactcaaaatcgaaggccagggtgacggcttcacgtacccgccggtctttaaataccgggcgctgaatattaaaggccagccagcgtgtgtcctgcgccgactcgtttttctgctcttctttaatgatgtaatgattatcgaaatttttaccgatatagcgcgttgcccagtttttagcgtcgttttccagccgtagatcaaatgcgcccgctttaaacgcctcgaaagcgacattgtcatcaaggtagtaatcgtagcggacagtgtcgaggttaaaacgtccacgattgaccggcagattagccgcccagtagtttttgacgcgtgaatagacaatgtactggcccattttccactgagtaatccggtatggcccgctggctaagggcggcgttgaaagtggatcgctgagtttgtgatttttccagaatttttcgggcatgatcggtagtgaaaacagactaagcatgtcttctttaccaggcttcgccagctcaattcgcacggttaaaggcgcaatcgccttcacggtagtacctttatagaccagacggaactgcggtacgccttcggtcataaacttatgaaaggtaaaggctacatcgcgggcggtaatgggcgtgccatcgtgaaaacgagcgcgggggttaatcgagatttccacccaggaatagtcggcggcatagcgggcatggtcggcaatcagcgggtaatagcttccgggttcatcatccgaggtggtaaaaagcgtatcgtaaagggcttcggtacgtacgccgggattgccgcgcagcgaatagcgattgaaattatcgaacgtaccaatggcggaaagcgtcatctgaccgcctttcggcgcagcaggattcacataatcaaagtgatcaaagttaaaagcatacttaggttcgccgagtacggcgaaagcgtagctttctttgatttcctgggcctgggcgccagcgctaaccagtgcgacaagcagaagcattacgcgcgcaatcatctgaaggcggtttccttatcgtattgcccgctgcaaaccggcaggcgtttcgctgaataataagtgacgttgcgtctgatgtgaatccgttaaaaccgtaaggggactaccattcaggcacggaaggcgccgacatccacagcacgaaatcttttaggggtaaaggacggctaatccagtacccctgcaagtaattaacaccgtgatcgcgtagccaacgggcctgctccggcgtttcaacgtcctcggccaccgtcagcatattcaggcgtctggagagcgtcagcacggtatccagaaccggagacgtgacggtttccgtgccgatcgcctggataaagccgcgatcaattttcagataatctaaagtaaatcgctccagataaatcagggcgctatggcctgtaccgaaatcatctatagcgatttcaaacccggcggaatgcagccattcgaacagtttggccgcttcatactgctgaagcatattgcgttcagtgatttccagcacgatatgaaaatggtgcgcgggcagggcgtccctgagccggtgcatatcctctttaaaactgtcgctgtgcagatgttccggcgcgatgttaatgccaaatttggcaccgacgggcatcaccttctgtagcgtgggtgcgtcgcgggcgatcagctcgaacagatgctgcgttaacggtacgataagttgctgcgcttcggcatagtggataaaggcatccggcggaatctcgcctgccgtagggtgacgccagcgcagtaagacttcaagcccggtgacgcttagcgtacgagtatcgacgacgggctgataaaccacataaaactgctcgtgtttgatcgccgttaaaatctctttgcccggtcgcgtccggagggcatagataaagtaacagataaaccccgctacgatgccgctaatgcagcccagcatcaacgcataccacaagtcattgtaggtccagctatcggcataaagctgtattttaagcggcaggccgttgatagttgcctgtcgtgaaggcgtgcccggcagctccgcgacggtcagcagacgcgaagaaaaggtcgacagcgcggtattgccgacaatcagcgcgatgccgttaaaatcgtcctggcgcgtggtatagagtaagtagggcgtcaggttaatattcagcgatgtgaatacgccgctgttatttaataatgggtttcgataccaaatcaccattgtcggtttgttgggcatcattggcgtgccgggcagaatcgccatagcaacgtctttgcggatatctatatccggtaccagttgctgaagcggcatattcatggcgccagtggcggaagagcagaacacttttttatctttaatcaataagaaggcgcggacattaaggctaaaagcggctcttgaggtgagttctgcgccaacctgctgacaggtgttgatcgtcaacggctgaagaatatcggtggtggctttcaggtcggcgaaatagctggctaggtaatgttgtacatcagaaaggagcgtattgtatttaacatcccgtttatgccacgacaggaaaaattgcaggctaccaataagtaatgctgccgctatccccgtaatgatacaggtaagcaggattttccgaccggaagaggagtcgcgtgtaagcataattcctggtgtgacctgaaaaggcagatgccggttaaactggttgatttataagactatagcctggattaccccggatagtcatgcttttctgtgatgcgcaggaaagcgtattgtcgcagtagtcgttggcggaaacgacctgaatgtctgatggcgctatgtttatcaggcctatgttcgtgtgttgtaggctggataagaggcgacacgtcgctattcggtaaaacgggttcagaagggataataagcaaaagcactgctgaagcagtgctttttatgtcgtctcatcaggtaagccaagggaggtgctgcctgatgaagattaactgcggctcagaactcgacgcgcttcattgtagcgttttttccagtacggttcgttcatactggagataatgacgccgctactggtagacgcatggacaaattggttattgccgatataaataccgacatgacggccagtggaaccggcgcggaacagaaccagatcgcccgtacgcaggttattgcgtgaaaccgctttgcccatttcctgctgttcataggttgaacgcggaagctctaaaccaaactgttcgcggaaggtgcgctgtacaaagctggaacagtcgacgcctttcttagtgctgccgcccaggcggtaacgcacacctttccagtcagcatactgatccataatccgcgacttaacgtcgaggttacgcaccatattttcaaattcatcctgagaggcttgcagtgaagagctatcgctattgcccacagcatgcgtctcagaatgcatattctttgcggtattggtggttgtgctacaagcagaaagcagaaccgcaactgcaatcgcaggaatcccgcgcaaaatatatctcaaaatcggttgagatttgaccatgttgtttgttttcccttgaagtccttaacgataaatatcgttataaaaatgccaaacgtgatgagactaattacctgcacagcttgagacaattctttgtgcacaaatctgtggcggaacgcacaaatttattcgcaatgagaataattatctggcgaggcaaaacgagtttgagattacccgattgttgctgtcattgcgagcgatttcgcgtgattttttataagaatttatgatacgaaaagtgagctatcagcacgggtcaaattaagcgcaaatcgtttaaaaatcgtgcaacctgttcattttgcagaggaataatattaccgaaaaatgatgggctgggggaatatcatcataaattaccttcaacgatgtaaaactatcgctgaaggcaatgttaattgtatgggttatttgtttaaaatttgtttatttccgcctgggagataatcctcaaaaagcgctatcgcccggtcgctgagcggggtcatcagccaccaggggaggccaatcaaaataaccgtgagcgacccaaccacaatatcggtgaaccagtgagcgccaatcataacgcgcggaaacgcgaaaaccacaaatataataagggcgataatccccgccgttttgccgaaataacgcagcataaaggcggaaaatatcagcagcatcataccgtgatcgcctgggaaactgtcttttgacgcgtcttttgtcgggatgtgcagcaactcgctgacgcgataaatatgctcaaaagagagcgttggactggcgcgcttgacggggatcagcgcctgaccgagttggttaagcaccaccgctgttagcagcatgaccaatccgattatcacaatgcgccgccggcccgacgcgtcttcttttagccagaaactgagcatcagtccgcccatcgccagcagcgaacagccgtcaaacgcccgattattggtaatagcgacccaccagaggaacgcgtggctttccaccagtttctggttaaagaagtggaatatgccggaatcaatggtgaaccagaaaccgtgattgacgggaagataccatgacaaaaacagcgccagaccggcggcattaagcagaattatcaaggaatagcgggttttcatcgtcatttcgccatagtttttaaacggtggcaaccttacgcgtgcgtcgctaaacgaagcttcaacaaggccgtctgtaacgtattccagtcggtttctgtgtttgagataagttcaacccggctatccggcggcgcgacactctgtgtttcgatgtgcaggtcatcgccctggcgattgatgcgtaccagcccctcttgtatgcgcataacgcctttcacccggcccaccggcgccagacgagcccattcgagtaggccaatggtgtcaaacacggtatcggcatcgaaaatccagccgcaggcctgatgaccctgtccgctattgaggctgcgtcgccagcgctgctgtgcgggcagatttagcgcggcgagtccttttttactggcatgagtgtgagaatgcgcggcgctggccggcagttccgccagattttgtcgcggtaaatccagaagcttaccgtctatctgtccatgttcggcatgaatcagttgacgatcgccgccgtactgtcgccaccactgttgcagggcggcatcgctctgcgccgtggcgcggtcggttttattggcgatgataatatcggctgaggcgagctgatcgcggaaattttcattggcgacgctctgttggtccagtagcaggcgagggtccaggatgcagagcgtggcgcgtaaatcaatccacggctcataaaccggcgcagttaataaatccagaatctgttttgggtgccccagtccggttggttcaatcagcaaccggtcaggtttgccctggcgcagcagcgtgttgagccccacctgcataggcaatccgttgacgcagcacatgcagccgccgggaatctcttttagcagtgcgccgctgtcggcaagcagcgcgccgtcaatacccacttcaccaaattcattaaccaggacggcccacttttcagccggatctttatgagctaataaatgaaggatagaggtggtttttccgctaccgagaaatccagtaataagattggttttggtcacgtcagctccagaatattgatacaacataacaacttttaataatcctggcgaataaacgtgaaaaagagaagtgctgagttgacgaagtcgtgcttctgccatcttaagagcagaaaatgttaaatttttaacgtttctcttgcctggtgcagaacagtcaataaataaaaggggcagactgcgccctggggcgcagccgaaaaatgtgaaacttaatccgcgcgccccatataacggcgctcttcgatatgaatgcggattttctcacctgcgctcaggtattcgggaacctgaatcaccagaccggtgcttaatgtcgcgggtttgttacgtgcgctggcggacgctcctttaatacccggtgcggtttcgacgatttccagatccacggtctgcggaagctctagcgccagcagttggccgtcccaggtcagaacctgcatatccggcattccgccttcaggcataaacagcaactcttcttcaatctgatctttggtgaaggtatacggcgtatagtcttctttatccatgaacacatattcgttgccatcgacataagaaaagtcaacgccgcgacggctcagggtgacggtatcaacgatatcgtcgcctttgaaacgttcttccactttcagaccggtgcggacatcggaaaagcgcattttatacagtgtggcggcgccacgggcggtaggcgactgaatgtcgatatctttcacaatcagcaatttgccgttgtagttcagtaccataccttttttgatttcgttcgctcttggcatcgaggagatcctgttgtagagattatctaaaatatcgcgtaaaactactcgcgccgggccgtccaggcaagtggaattgtcacttttgctggtgcaaaaaaggtgatactgttcgcccgctttccgctccgcgttcaacgagaatacgcgatggcatgtcgcctggaggggggaagtgtgctgtgttgtcccttctgtttccagccttgtcttcggaatgtctgaggacaggcctgatcatgatgacgtccacattttaaatctggatttttctttggacaaattctgttatctttcatttggttataaatagaggggctgagcatggactgtcgtagcggttgtggcgcttgctgtattgcgccttcaatttcgtcgccgatacccggaatgccgaatggcaagccgatgaataccagatgcgtgcagctttcggaagataacttgtgtcttatctttggctcgcctttacgcccaaaagtgtgctttggtttgcaaccgacaggggacatgtgtttaacgacccgggaagaggccattatttatttgctggaactcgaacagaaaaccttaccatgagctaatagcctaatgggataggctctaagtcagctgtttttgataaacgtgcaggggcttacgttatatcccgaaatagtctgcaaaagctgcgcatcaaattacctccttttaccattaaatagcgtaatacatgcttcccttatttcgtgtcttctgaaacggtagatgtcgccgctcaaccccgttggtgcctgaacgtgtaccgaacaaaccgtcacataaaacaaaagcgatcaattttatttatatgatagtttttatctattaaaaagaggaattttgatcgattttaattatttataacgatcgatatcattagtttgatagtttatatctatcattgatgtatttaccgatcgatataaccagtgtgaatgtgttgttattttcctttaaaatactcgaattcttatgtgtgggttttatcttatgaagaaatatacgttcgcagccagggcgtttatttttacgttggtgttgctttttgttatttcagtattcgggttgactattagcgttttaaaagggatgtgaaatgcggggagaaaatagtgaaattgatttagtcgacgtttccttattccttataagaaaatggctaagtatcgtgatcgctacctttatttttgtcgccattggctatgtttttgtgagcgtgcatcatgatacaaaggttgtgagtattacaatcaaacctaatctggatacgcctgctacctatgcgttatgtggctatgctaatgatattcaatgtaaaacaacggttatccttaaccagtttagccgtttcttgcctgcggaatataaaaataaaataagttttgacgcgaaaaatcagcttgtcctttttaaggcgcaggggagggaagaaagcgtcaataatattatttccaccctgaaaaatagcgtcgataaaatggcagcatggtatatcgatgatggtgacattaaacgttatagcgtgcataaaaatatgttacaaacggaaacatatacaaagctatccttgttgtcggaggcggttaaaaataatgctaacattgaagtgatagatgttgctgttacaccaaaatataagatgcggctggtgttggtcctttgcgggctgatgggcgtaattttctcaataaccggtctcttatgtaagagggcgctaacagaatatcgtattgagaaaaagacaatgaatgaccgcgcatgaacatcgcgcagaaataaattctgcgctgaaatgtgtcgaagagtaaaagtatcaggcttgcaagttaaacatctttaatacgcgccaggcagaacatggtggcgacaatcataactaacgcaaaccagaagaccgcatgataattccagatttctgcggcgattcccgccaacgaaccggcaatgatccagccgacgcgaatggtattggtatacagcgtggtggctgaacccgcctggcctggcatgagatcctgaaaatagagcatgccaatcccgccaagaatgccgatgtaaatcgcgttcagcaactgcaagccgagcaacgttgccggtgcgtgcgccagcaacatccccgcataaaagcacagtccggcgacaacggcgatgcacattaacaggcgttttcccaaccgtttggcgaagtaacctgcaatcagcattgtgggaatctccagcccggcggcggtgcccatcatcacgcctgcaagtttttccggaagatgcagctcattgatgataaacagcggcatattaatgatatacaggctgttagtcccccacattaacgtacagatgacaaacagcaacagcgtatcgcggcgattacgacgcggtgcttccagcgtgccggttgccagcggcgcatctttgcgcattgacggtaaaaagaaccacaccatgacgccgcagacgataaaagctaccgccgcgctcaaatacatcaccgtaaagctaaaacccatcgccagcgcataggccagcggcggcccaatgacccaggccaacgagacctgggcgcggaggattgagctgaacatcaccgcttcacgacctgtacgatcggcatgttctcgggccagcgcaaacatctgcgggttggcggtagagccgaagctactgagaaagacgccgatgaacagcaaaataaagtagttgcggttccaggcaaacaacacgcaggccaacatgcccagcacgcaacagaaaacgatcagttttttgcgatcgccttttttatctgagcgacccgccagaaactggctcacgataatgccgataaccgcgctgccggtaaaaaagaaacccaccatgccgggacgggcgtgaacctcatccgtcagaaaaatactgagtgtcggcgtctgtaacgcaccagcaataccggtgagaaaagcgacgatcaaaaaggcggtagacgtcaggtcaaacgatttgggcgcagcggcggcgggactgttgtgcatgtttctatatcagtggtgtgaagagaggcggagtttacgctgcccgtcagaaaataaacaggcgtctgaatcaaaatcgacacgaaaaatcaaaatagcattccagtttgttacaagggcgtgctgacgcaagctgaaagaaaaaagctgaagccttttatgcgtcagctattgagggtctgttggagaaaaaatgtgcttcacctcaaaaaattgctacaaaaccggtaacttttcttgcgtgctgaagcagaaagatccagactttcttgaaacgtttcagcgcgatctggtttttttgataactcagattggcgctttttttctcatagtggctgaatcgtttcaattcagcaggagaggagacacatgttccagttatcggttcaggacattcatccgggcgagcaggccggaaataaagaagaggccattcggcaaatcgccgctgcgttagcgcaggcggggaatgtggcgggcggctatgttgacggtatgctggcgcgcgaacagcaaacctcaacctttcttggcaatggtattgcgattccccatggtacaacagacacgcgcgatcaggtgctgaaaaccggcgtccaggtctttcaatttccgcagggcgttacctggggagaaggccaggtcgcctacgtggcgattggtattgccgccagttcggacgaacaccttggcctgctgcgtcagctgacgcatgtgctgagcgatgactccgtggctgaacagctgaaatccgcgacaacggcggaagagctgcgcgcattgctgatgggcgagaagcaaagtgaacaattaaaacttgataacgagacgatgacgctggatgtcatcgccagctcgctggtcacattgcaggcgctaaatgcggcgcgtctgaaagaggcgggagcggttgatgcggcgttcgtcgcaaaaacgattaacgatagtccgatgaatctgggacaaggcatctggctgaacgacagcgcggaaggcaatttgcgcagtgctgttgcggtaagccgcgcgacccaggcgtttgacgtagagggtgaaaaagcagccttattagtcactgtcgcgatgaacgacgagcagccgattgccgtgctaaaacgcctcggcgacctgttgctgaacaataaagccgatcgtctgctgagcgctgacgccgcgacgctgctggcgttgctgaccagtgatgatgcgctgacggatgacgtactgagcgcggaatttgtagtgcgtaatgagcatggtctccatgcccgtccgggcaccatgctggtgaatacgattaaacaatttaacagtgaaattaccgtgacaaaccttgatggaaccggcaaaccggcaaacggacgtagtctgatgaaagtggtggcattaggcgtgaagaaaggccatcgtctgcgctttaccgcgcagggtgaagatgctgaacaggcgctgaaagcgattggcgatgcgatcgccgccggtcttggggagggcgcataatgagcaggcgtgtcgccaccattacccttaatccggcttacgatctggttgggttttgccctgaaatcgaacgcggcgaagtgaacctggtgaaaaccacgggtctgcacgcggcgggcaaaggcattaacgttgccaaagtgctgaaagacttaggcatcgacgtcactgtcggcggttttctcggtaaagataaccaggacggttttcagcaattattcagcgaactgggtatcgctaaccgctttcaggtggttcagggccggacccgcatcaacgtgaagctgacggaaaaagatggcgaagtgaccgacttcaacttttccggctttgacgtgactcccgcagactgggaacgctttgttaacgactccctgagctggctgggtcagttcgatatggtctgcgtcagcggtagcttaccggctggcgtgagtccggaagcgttcaccgactggatgacgcgtctgcgcagccagtgtccatgcattatctttgatagtagccgtgaagcgttagtcgccggtcttaaagctgcgccgtggctggtgaaaccgaatcgccgcgaactggaaatttgggcgggtcgtaagctcccggaaatgaaagatgtgattgatgcggcgcacgcgttacgcgaacagggtatcgctcatgtggtgatttcgctgggggcggaaggcgcgctgtgggttaacgcctcaggagaatggatcgctaaaccaccggcggttgacgtggtaagtaccgtcggcgcaggcgattccatggttggcggattgatttacggcctgctgatgcgcgagtccagcgaacatacgctgcgtctggcgacggcggttgccgcgctggcggtcagccagagcaatgtgggtattaccgatcgtcctcagttggccgcaatgatggcgcgtgtcgacttacaaccgtttaactgacagcaggagaggcataatgaaaacgctgctgataattgacgctaatctcggccaggctcgcgcttacatggcgaaaaccctgcttggagcggcggcgcataaagcaaatctggaaattatcgacaatccgaatgatgctgaactggcgatcgtgctgggcgaatctctgccgaacgacaatgctttgaacggcaaaaaggtttggctgggggatattggtcgcgccgtcgcgcatccggaactgtttctgagtgaagccaaaagccatgcgaccccttacagcgcccctgctgcggctgctcctgcagcgagcggcggtccgaaacgcgtggtcgcggtaacggcctgcccgaccggcgtcgcccatacttttatggcggctgaagccattgaaacagaagcgaaaaaacgcggctggtgggtaaaagtcgaaacgcgcggctccgtgggggccggcaatgccatcaccccggaagaggtggcggaagcggatttagtgattgtggcggcggatatcgaagtggatctggcgaagtttgccggtctcccgatgtatcgcacgtcgaccggcctggcgctgaaaaagacggcgcaggagctggataaagccgtagcggaagcgacgccgtatcaaccggcgggtaaggcatcgcaagcggcgaccgaagggaagaaagagagcgctggcgcataccggcatctgttgacgggcgtttcttacatgctgcctatggtggttgccgggggactgtgtattgcgctttccttcgcctttggtattgaagcctttaaggtgccggacacgctggcggcggcgctgatgcagattggcggcggttcggcgtttgcgctgatggtgccggtactggcgggttatatcgctttctccatcgcggatcgccctggccttacgccaggtctgattggcggtatgctggcggttagcaccggttccggttttatcggcgggatcattgccggcttccttgccgggtatatggcgaagcttatcagtaccaaactgaaacttccgcaaagtatggaagcgctgaagccaatcctgatcatcccgttaatttccagtctggtggtggggctggcgatgatttacctgatcggtaaaccggttgccgggattctggaagggctcacccactggctgcaaaccatggggacggcaaacgcggtgctgttgggcgcgattctcggcgggatgatgtgtaccgacatgggcggcccggtgaacaaagcggcgtatgcgtttggcgttggtctgctgagtacgcaaacttacgcgccgatggcggcgatcatggccgcaggtatggtaccgccgttagcgctgggtctggcgacgatggtggcgcgtcgtaagttcgacaaagcgcagcaggaaggcggtaaagcggcgttggtgctggggctgtgctttatcactgaaggcgctattccgtttgcggcgcgcgacccgatgcgtgtactgccgtgctgtatcgttggcggcgcgttgaccggggctatttctatggcggtaggcgcaaaattgatggcgccgcatggcggtctgtttgttctgcttatcccaggcgcaattacgccggtattgggatacctgctggcaattgtggccggtacgctggtggcaggactggcttatgccgtcctgaaacgtccggagacggaagtcgcggcaaaagcggcataagagaaacacgctaaaaaaggcagagcgcgctctgccttttttattgcctgaagaacattgagcgtcaggccatcgcttcggcaatttgctgggcttttaaccacgcaatctcttccgcccagatatcaggattgatggtctccagtatcagcggaataccgtcaaaacgcgcatcctgcataatccaacgaaacgcatcgtggccgatattgccttcacccagactgtgatggcggtcaacgcggctaccgaaggcgcttttggcgtcgttaaggtgcattccgcgcaaatactgaaatccgacaattttcccgaattcggcgaacgttttttcgcacgcctctggcgtacgcagatcgtatccagcggcaaaggcatggcaggtatcgatacagacgccaacgcgcgacttatcttccacgccgtcgatgatggcggctaactgttcaaactcaaaccccagattactgccctgaccggctgtattttcgataaccgccgtaacgccctcggtctgcgcgagggcaatattgatagattccgcgatccgcgccaggcaattctcctgtgcaatctgcatcagatggctaccgggatgaaaattaagcaaggttaagccgagttgttcacagcgctgcatttcatcgagaaaggcatcgcgtgatttttccagcgcttcactgaccggatggcccagattaatcaggtaactatcgtggggaaggatttgcgccgccgagaaatgatacttttcacaggcgattttaaagtcatcaatgacctggggagtaaggggggcggcacgccactgacgctggttttttgtgaaaagcgcaaaggccgttgcgccaatttcagccgcgcgggcaggggcgttagccagaccgccagcagcgctgacgtgcgctccgatgtatttcataaaagactcctgttaaacccgctaacggttcattacgaacgctatgataacgggttaacaggcgtgaaacgtaataatttatgcgataaggctatggattaggacgttaatggcgccaccgccaataatcagccaggcgaataatgccagcgccatcagcagcggtttcgcccccgcttttttcaatgcgctaacgtgagtggtcagacccaacgccgccattgccatcgccagcagtaccgtgtccagcgtcaccagcatatccaccacggctttcggcagcaggtggaaagagttgaagatcgccactacgatgaagaaaatagcaaaccacggaatggtaattttgcttttttccgcgccggtcgccggggaaagctgtttaacgcgtgccgccagaatgatcaggaacggcgccagcatcatgacacgcagcatcttagcgataactgccgcattttccgcatccgggctaacggcgtgacccgctgcgaccacttgcgcgacttcatgcatggttgagccgatatagatgccgtaagtttccgggctgaaccagtgcgccagcagcggatacattgccgggtaaaggaaaatagcgatggtgccgaaaataacgacagtcgcgacggctacagtaaccttactggcttccgcttttaccaccggttctgtcgccagtaccgccgccgcgccgcagatactgctaccggcgccaatcagccagctggtatgcctgtccagaccaaagactttttggcctaagaagcaggccagcatgaacgtgctggaaagcgttaatacgtcaatcacaataccgctaatacccacgtcggcgatttgtgaaaaggtaaggcggaagccgtaaaggataatccctaaacgcagtaaatgttgttttgcaaacagcacgccgccgtcgcattgtttccatatttgtggatagacggtattcccgataaccatacccagcaggatagccagggtcagggcgctgaaccccgcgcctgcaacagcagggatagcgccgccccacagggcgactcctgtaatgacggcgctcagagcgagccccggtataaaatgccacattgtacgacgatgattctgcaaggtgagttctgtcataaccttctcctgtatatggacaataaggttacggtgatctggtttaaaaataaaattgattatatatttataattaatctttataagtggtaagtgaaacgctatcggtgggatacgactatgcatattacgctacgacaacttgaagtgtttgctgaagtactgaaaagcggttcaacaacccaggcgtcggtcatgctgtcattatcgcagtccgccgttagcgccgcgctcaccgatctggaaggtcagctcggcgtacagttgtttgatcgggtggggaaacggctggtggtcaacgaacatgggcgcttgttatacccgcgcgcgctggcattgctggagcaagcggtagaaattgagcagctatttcgtgaagataacggcgcgatacgggtttatgccagtagcaccatcggcaattacattttacccgccatgattgcccgctatcgccagcattatccggccttgccgctggaactcagcgtgggaaacagccaggacgtgattaacgcggtgttggattttcgggttgatatcggcctgattgaagggccgtgtcacagtacagagattatctctgagccgtggctggaagatgagctggtggtctttgccgcgccgtcctcgccgctgacgcaggggccggtgacgctggaacagcttgcggcatccccatggattttacgcgagcgcggttccggtacgcgggaaattgtcgattatttgctgttgtcgcatttgccgcgctttcatatggcgatggagttggggaattcagaagcgatcaaacatgcggtgcgtcatggactggggataagctgtttatcgcgccgggtgattgctgaacaacttcaggcgggaaccctgggcgaagtcgcggtgccgttaccgcgcctggtgcgcacgttgtggcgtgttcatcatcggcagaaacatctttctaacgcgttgcagcgttttttgagttactgtgaataaaggtgaagaggagggctgcccgagcggcatcgccatttttagtatccgcttacgtatacgttattctctgctttacttataatccgtggccggtcatgaaggtctcttataaccgcgcatttgtgtcggaaggatagtatttcgtctgttacaatcgcgcctcattttttggatggatagcattttcacatgggttccaaaactaaaaccacagaagcgcccgcgctacgtcgcgaattaaaggcgcgtcacctgacgatgattgccattggcggctccatcgggacaggtcttttcgttgcatctggtgcgacaatttctctggcggggccaggcggcgcgctgttttcttatattctgattggtttgatggtctacttcctgatgaccagtcttggcgagctggcggcctatatgccggtatctggctcgtttgcgacatatggtcagaactatgtggaagaaggctttggtttcgcgctgggctggaactactggtacaactgggcggtgactatcgctgttgacctggttgccgcacaattggtgatgggctggtggttcccggacacgccgggctggatctggagcgcgctattcctctgcgtcattttcttgctgaactacatttctgtacgcggttttggcgaggcggagtactggttctcgttaattaaagtcgcgaccgttattatcttcatcatcgttggcgtagcgatgattatcggcatctttaaaggtgtcgagccggtcggctggagcaactggacgacgggcgatgcgcctttcgctggcggttttgcggcaatgattggcgtcgcgatgatcgtgggcttctctttccagggaactgagctgattggtattgccgccggggaatctgaaaacccggagaagaatattccgcgcgcggtgcgtcaggtgttctggcgtattctgctgttttatgttttcgcgattttgattatcagcctgatcattccttataccgatccaaacctgctgcgtaacgacgtcaaagacattagcgtcagtccgtttaccttagtgttccagcatgcgggcttgttgtctgcggcggcgataatgaatgcggttatcctgacggcggtactgtctgcgggtaactccgggatgtatgcctcgacccgtatgctctacaccctggcctgtgacggtaaggccccgcgtatttttgcgaaattgtcccgcggcggcgtatcgcgcaatgcgctttatgccaccaccgtgattgccggtctttgctttttgacctcaatgttcggcaaccagacggtctatctgtggctgttgaacacctccggtatgacgggcttcatcgcctggctggggattgccattagccattatcgcttccgtcgcggttacgtgttacaagggtatgatgtgaatgatttgccgtaccgttccgggttcttcccgctggggccgattttcgcctttgtactgtgcctgattattacgttggggcagaactatgaagcgttcctgaaagataccatcgactggggcggcgtcgcggcgacctatatcggtattccgctgttcctgcttatctggttcggctacaagctgataaaaggcacgcatttcgtgcgctatagcgaaatgcacttcccggaacgcgttaaaaagtaacgtaatattctcgtcataggccggataaggctttatgccgccatccggcacggactgcctgaacctgacccttctaaccctctcattcgagagggttttttgttttttctttatgattggttcaaatgacataattattaacaattaaattgataattattatcgtttactttatcgttacgctcgaaatcagaaaggatgaagattcgggcgcgaccgtcactcatgagcccgactcgcctgcataaaaagagttcgccgtgataaccgttatcgcaggcgaaacgtaatgcgttgtgagcgataaccgatttttttgtcgtatttacctcatggagaaatggaatgtttaggtttaaccctttcgttcgggtagggctttgtatgtccgcagttacgttggcctggccggttgccgcggcaacggatgatggtgaaaccatggtcgttaccgcgtccgccatcgaacaaaatctgaaagatgcgccagcaagtatcagcgtcattacccagcaagatttacagcgcaggcccgtgcaaaacctgaaagatgtcctgaaagaggtgccgggcgtacagctcactaacgaaggggataaccgtaaaggcgtgagtattcgtggtctggacagcagttatacgctgatcctgatcgacggtaagcgcgttaactcccgtaacgcggtcttccgccataatgattttgatctgaactggataccggttgacgctatcgaacgcattgaagtggtgcgtggccccatgtcctcgctgtatggctccgatgcgctgggcggcgtggtcaacattatcaccaaaaaaattggtcagaaatggcacggcagcgtcacggttgactccactattcaggaacatcgcgaccgtggcgatacctataacggtcagttctttaccagcggtccgctgatcgacggcgtgctgggaatgaaagcctacggtagcctggcgaaacgcgaaaaagacgagcagcagagttccgccaccaccgctacgggtgaaacgccgcgcattgaaggatttaccagccgggatggaaacgtcgagtttgcctggacaccaaacgaaaatcatgacgttaccgcaggctacggttttgatcgccaggaccgggactccgactcgctggataaaaaccgactggaacggcaaaactacgcgttgagccataacggacgttgggatctcggcaatagcgagctcaagttctacggcgaaaaggtggaaaacaaaaaccccggcaacagtagccctatcacgtcagaaagcaattcgattgacgggaaatacgttctgccgttagcgtctgtcaaccagttcctcaccttcggcggcgaatggcgtcacgataaactgagtgatgcggtgagcctgaccggcggttccagtactaaaacctccgccagccagtacgctctgttccttgaagatgagtggcgcatcttcgaaccgctggcgctgaccaccggtattcgtatggatgaccatgaaacctatggcgatcactggagcccgcgtgcttatctggtctataacgcaacggataccctgacggtgaaaggtgggtgggccacggcctttaaagcgccgtcgctattgcaattaagtccggactgggcgaccaactcctgccgtggcggatgccgcattgtcggtagcccggatctgaaacctgaaactagtgaaagctgggagctcggcctttattaccggggcgaagaaggcatactggagggcgtggaagcgagcgttaccacgttccgtaacgatgtggacaatcgcatcagcattagccgtacccctgacgttaacgccgcgcccggctattccaactttgtcggcttcgaaaccaacagtcggggacagcgcgttccggtcttccgttattacaacgtgaataaagcacgtattcagggtgtggaaaccgagttgaaagttccgtttaacgaggcgtggaaactgtcgttgaattacacctataacgacggacgcgatgtcagtaatggcgggaacaagccgctttccgatctgccgttccacaccgcgaacggtacgcttgactggaaaccggcgcagcttgaagactggtcattctacgtatcagggaattataccggacgtaagcgggccgacagcgcaacggcgaaaacgccgggcgggtacgtggtctgggataccggcgcggcatggcaggcgacgaaaaacgttaaactgcgtgcgggcgttctgaacgtgggcgataaagatctcaaacgcgacgactacggttataccgaagacggacgtcgttactttatggcggtggattaccgtttctgacagagactggcgacagccgcgttttgccgctgtcgccagaatgttataaccgatgcagcctggagagcagcgccagcgacagagtcgttagcagaatggcgattaacgcatagatataaacgcccgaccacgcccagctatttttcaccataattaccggcacaccggccattgccgcgccgacatagctgaacaatccccgaaagccggtaatcgatcccgccgcatccttatgggtcacatccagacagccgacggcaaaaagcatatgcggtccgtataaggcgaagcccatgatggtgaacagaatcgcgctgagggtgtaagaggtatcctgaaccagcggcaccagcacgatgcatatgcacagcgctaacgcgaagattaacccggtcatccagcggttacttttgaacataaagtcagacaagtagcctgccagcaacccacctgccagtccgcccgcctcaaatcaggaaataatcgagttcgcttttatcagactccagccgtgaacctgcgaatagtaaatctgcggccagtcgttaagaatagtgcgcgcaatataaaccgacatatcaccgataataatgatccataccagtggattggtcaggatatatttcacaaaaatctgccagaagctcaggttgaccgggctggccttgacctgggccagttccgtcgggtcgttacgccactgccccacgttgggcaaacctaacgtaccgggacgatctttaatggtaaatagcgtcactatccccatcagcagcgaaatggcgccgggaacataaaatcccattttccagctaccgctaaaggcgatagcaaaactggtcagcagcggcgcgaggctgccgccgatattgtgcgccgcttcaacgatagcccaccagcgtccccgttcgtttttcgaaaaccacgaggccataattttcgccatcggcggaaagctggtgccctgtaatatcgcgttgagactgtacagcacgtagaatgccgccacgctgtcggaaaagccgaacagaatatttacaatccccacgccaatcagcaccgggccggtcatggctttcgggttaattttatcgaccagcatcccgccgacaaacttcatcgcgccataaagaatgtaaaaaatagaagacataatggcgaagtcttctgcggtcagcgacgtttccgtcagcatggccggcatcgcggcggagaagtttttacgggtaagataaaagacggcataagagataaagaccgaggcgataatctcaaaacgaaattttttataggtctggtctatctcttttttctcttttacaatcggcttatcgggctggctgaaaataaatgtttttatactcattttaaaattcccttccggcgaggtgagtcgcgttataattcatcttcaataagaaaaagaagcaattcgaaaccgtgataattaatctgatggtggattttttcccgtacaaccggcttcgctttccaggcaataccggtgccagcatgttctaacatcggcagatcgttggcgccatcaccgcaggcaataatattctccgtggcaatatttaaccgggcagccaggtcaaccagcgtctgttttttgtttgcggcgttcataatcggcaaggtaatgttatccgtcagaacgttatcgcgtatttcaaccgtattcgaaaaggcataatccagttgataccgcgcttttagacgctgggtgaatatatccagtcccccggagataatcgcggttttaaatcctttggccttgatgactggcagaatagttaacaggcctggcgaaagggtcatgcgatcgcatacggcgttcagcactgctttcggtgtgcctttcaacattccgatacgtcgggtaaaactggcgttaaaatcaagcttgccctccatcgcctgttgggtaatggcggtgatttgcgtcgacatgccaagctcgcgggcaatttcatccacgccttcttccgcaataaatgtcgagtccatatcaaacgcgataataccgttagcaggcagtggctgcggcttaataaaaaaatcaaactgccattgcaatgagagttcgcgtaaatagcgataaaattcaggcgtcagacattccgctggcagcgtaagctttaaataagcggtattgataagcgcggcataacgtttatcaaataatagcggaaacggcatggtgacggcattaaataacgtttcctgtaattttttctgaaacgtatcgatatcctgtgtagtaataaaataaataatgctcatatgataactcccttaatttacgggtattataatggctcttttgcggcgtggaatctcgtgctatcacagatatcacagccagaaaagggctaaaaaagcgttgtttttgataccaggtaaagttcagacacaaaaggtatcacttttgatatgccaactgtgcgaggatgttatttattactgaacgcgaatgagactgaaaggattgatataacgatggagagttgccttgatatattcaaaatagtaataggtccatccagctcacgtaccgtagggccgatgcgcgccgcctgtcactttatttcattgctcagagaacaagagacgttgccgctaattcgggaaattgaaatcgagctgtatggcgcgttatcgttaagccgcaagtgccacaatgtggataccgccctgtatcttgggctgctgggttgccagccggagaatgtcgatctccgttcgcatatggcggtgattaagcgtgcggaaaatgaaaacaaaatcgaactcccgctctctgacgcgggcggaatcacgataaaagtcaagattatcgccaatcaccaggcgcatccaggccatccttatgccatgacgttttgcgccagggatgattattttacggtgtatgaagagacctggttttctaccggcgccgggcaggttcgtaaacatggcgagccgctgacgccatcgcttcctttgcgtacagtgtcgccctttgaatttagtcatgccgcgcagttgctggcgctgtgtcggcgtaacggcctgtccgtggcggcgctgatgatgaaaaatgagctgtgccgccactcgccacagacgttgcagaattatctggcgcaaatatgggacgtgatgcagcaggcggtttatcgcggcctgcatactgagggggtattacccggtccctatcaggtaccgcggcgcgcctgtgcgttacataagacgttacaggctaaccgctccgccagcgattttttaaccgcgctgaactgggtcaatgccttcgcgattgcggtaagcgaagaaaatgccagcggcggacagattgttaccgcgccaaccaacggcgcgtgcggcatcattccggcagcgctctgctggtatgataaatttgtcacgccgctggagcccggtgctctgacccgtttcttcctgaccgccgccgctatcgcgatgctgtttaaacaaaacgcctctattctgggatctgaagttggctgtcagggggaaatcggcgtggcgtgctcaatggcggcggcgggcctggctgaactgatgggtgcatccgtggagcaaacgctgagcgccgctgaaattgccatggaacatcatctgggattgacctgcgatccgctgggcgggcaggtacaaattccctgcatagagagaaatgccatctctgccgtgaaagcgataaacgcggcgacgatggcgatgagtcgcgtaagcgaaccctgtatttcgctcgatgagatcattgctgcgatgtacgagaccggtaaagacatgagcgctaaataccgtgaaacgtatcatggttcgctggggaaaattcagccgcgcaagagagggtaacagcgtgaaatacaatacgatgaataacgatgagattatcctgtcgttgtgcgcccgcttaaaggagacgcgtctgtctcttgcgatgacccagcagcagcttgccgatcgcgcgcacgttggcattgccaccatcaagcgtatcgagaaggggggagggctcaatcttgatacgctaatttctctcctgcgggcgctggataagttgcataatcttgatgcggtgctgtttgaatccgaactgcgtaattttcacgaaagttatgaaggcggagagggcagcggccgccttcaggtacgccagcaggccgcggatttaaataataaatcttccgcgccgcagtcggaggaggtgaactacagcgcggcgctggaaaattcattatgttggtgacgtctcatgctcgtcccgtaaataccgggcatgaaagcgcagatggtcctcaatgaaggacgcaataaaataatagctatgatcgtaaccgggctggattcgtagcgtcatcggccaggcggtttgccgcgcggcttccgccagtacggcgggctgaagctgatcggcgaggaattgatcgctgtcaccctgatcgatgagcacaggaatggcgtcctgcggctggctggccagcattaattcgcagctatcccactcagtccaggctgattcatcttcgccgagataagcggtaagcgctttgattccccacggcacgcggctggggttgacgatgggcgcaaaagcagagatgctggtgtatttgcccggatttttcagcgccatgattaacgcgccgtggccgcccatcgagtgcccgctgatggcgcaacggtcgctgacgttaaactgtgtctggataagcgccggaagctcatcgcgcaggtaatcgtacatgcgataatggctggcccagggcggctgtgtggcattgagataaaacccggcgccgtggcctaaatcgtatccgctatcgtcggcgacctgttcaccgcgtggactggtatccggcatcaccaatacaatgcccagttctgctgcgatacgctgcgcgcctgctttggtggtaaaattctcatcattgcaggtcaacccggacaaccagtacagtaccggaggcggttcattatcctgagtcggcggaagaaaaatgctgaatgtcatggcgcagtttagcgtggcggcatgatgacgccagcgctgctgccagccgccaaaacatcggtgctcttcgagcatttccatgcgggggctccttttatagtgaacctgataaggtatgcagattcttcataatacagattattcaccgcgttgtgagtaactttcacttccgtaatacataaacatgcttcatcatttaaataacgttgcgttaacaaatatgccctttgtcctgccagcattctcgcaccggaaaagatgtcatgaaaggcagcgacaatttcaacaattatgggcgtgaatactggattatgtgcgctacctcacgcacaataatcacactgtcacaatattgacaaactttgccccatgcagggcagaggcgccacacctgcaggagaacacgattaatgccatcactcagtaaagaagcggccctggttcatgacgcgctggttgcccgggggctggaaacgccgctgcgcccgcctatggatgaactggataatgaaacgcgaaaaagccttatcgcagggcatatgactgagattatgcagttgctgaatctcgatttgagcgatgacagtctgatggaaacgccgcatcgtatcgctaagatgtacgttgacgagatttttgctggcctcgactatgctaatttcccgaaaattaccctcattgaaaataaaatgaaggtggatgaaatggtcaccgtccgcgatatcacgctgaccagcacctgtgaacatcacttcgtgatcattgatggcaaagcgaccgtcgcgtatatccccaaagattccgtgatcggcctgtcgaaaattaaccgcatcgtgcaattcttcgcccagcgtccgcaggttcaggaacgtttgacccaacaaattctgacggcgctgcaaaccttgctcggcaccaataatgtagcggtatcgattgatgcggtgcattactgcgtgaaagcgcgcggtattcgtgacgcaaccagcgccacgacgacgacgtcgctgggcggattgtttaagtccagccagaatacgcgccaggagtttctgcgtgccgttcgccatcatccatgattaaggcggagacgatggagcgtaatgtcacgctggattttgtacgtggcgtcgctatcctcggtatcctgcttcttaacattagcgcctttggattgccgaaggcggcttatctcaatcccgcctggtacggcgcgatcgttcccgaagacgcctggtcctgggcgattctcgatattgtggcgcaggctaagtttcttacgctgttcgcgttgttgtttggcgcggggctacaaatgctgcttccgcgtggtaaacagtggattcagtcgcgcttaacgctattggtactgttaggttttatccatgcgttattcttttgggacggcgacattctgctggcctacggtctggtcggattaatttgctggcgactggtacgcgacgcgccttcggtaaaaagcctgttcaataccggcatactcctttatctggtcgggattggcgtactactgctgctgggtgtggtatcgagtagcgaaaccagccgcgcctggacgccggatgcgtcggcaatattgtatgaaaaatactggaagctgaacggcggcatggaggctatcagcaaccgggcagagatgctgtcaaatagtttactggcgctcggcgcgcagtatggctggcaactggcaggtatgatactgctgggcgccgcgctaatgcgtagcggctggctgaaaggccagtacagtctgcggcactatcgccgtaccggggttctgctggtggcgttagggctaatgatcaacctgcctgcggtcattttacaatggcggctggactgggcgtaccgctggtgcgccttcttattgcaggcgccgcgcgaactgagcgcgccgttgcaaacgctgggctatgccgcgctgatgtttggcttctggccgcagcttagccgatgcagactgacgcttgccattgcctgcgtagggcgaatggcgctgaccaattatttgctgcagacgatcatctgtaccacgctgttttatcagtttggcttatttatgaaattcaatcgactggaactcttgttctttgtcgttccggtatgggcaataaaccttctcttttccgtcatctggctacgtttctggcgacagggaccggtcgagtggttatggcgtcaactcacgttgcgcgcgtcaggatcgctcagataacgatctggatcacattcattaacaaaatggctgtaaccgtttccatccctgtgatgtttctcacgcagccctgggcagggtgctgacaaaatagccgcctgctaacggggcatttgtgagcatttttgaactcaaacagggcagtgaatatgatcaccattcgtgatgtagcgcgccaggctggcgtgtctgtagcgaccgtttcccgcgtactgaataacagcgcgttggtcagtcccgacacccgtgacgccgttatgcaggccgtcaccctgctgggatatcggccaaatgcgaatgcgcaagcgctggccactcaggtgagcgataccatcggcgtcgtagtcatggatgtttccgatgcctttttcggcgctctggtgaaagccgtagatctggtcgcgcagcagcaccagaaatatgttctcattggcaacagttatcatgaggcggaaaaagagcgccatgcgattgaagtcttgatccgtcagcgttgtaacgcattgattgttcactcaaaagccttaaccgatcgcgagctgagcgactttatggatcagatccccggtatggtgctgattaaccgtatcgtgccgggttatgcgcatcgttgtgtctgtctcgacaatgtgagcggcgccagaatggcgacccgaatgttgctgaataatggacatcaacgcatcggctacctggccttcagccaccgtattgaagatgacgcgatgcgcagagaagggtggttacacgcgctgcaagagcagggggttgctgcgtcggagagctggattggcaccggcacgccagatatgcagggcggcgagtcggcaatggttgagttgctgggacgcaatctgcaactgacggcggtatttgcctataacgataacatggcgtcgggcgcgctgacggcgttaaaagataacggcatcgccattcccttgcatctgtctgtcatcggtttcgatgatatccctattgctcgttataccgatcctcagttgactaccgtgcgctatcctattgcttctatggcgaaaatcgcgaccgagctggcgttacagggggccgcaggcacgctggatatcacggcgacgcactgcttcatgccgacgctggtacggcgccattcggtggcgtggcgacagaatgcggtactgatcactaactgattacgccccgcatgtaaccgttttcaatctgtgagtaaattcacagtttattaacattgtgatagctatgatgacaacgtttgtcgcactgtaactaatgtgtaacagttagttgttagttttgctggggtatttcgcttataaaaaccattatcacaatatcccgcgactaccggacaaaaataaagagttgaataagagcttatcccattagggctattttacttgccattttggacctgggcagtgctcgccaaaacgcgttagcgttttgaacgccgctagcagcggcccgaagggcgagcgtagcgagtcaaacctcacatactacgtgtacgctccggtttttgcgcgctgtccgtgtccaaactggctgcgccaataacgcctggtgggataggctctaaatacgcttcggcgttcagtaacatgcgttaacgtgctgaacagccgggcatttttttacgctataccctacataataaaaccggagctaccatgaataagaaggtactgaccctttctgccgtgatggcaagtctgttattcggcgcgcacgcacacgcggctgatactcgtattggcgtgacgatttataaatatgacgataactttatgtccgtggtgcgtaaggttattgaaaaagatggcaaatccgcgccggatgttcagctactgatgaatgactcgcaaaacgatcaatctaaacagaatgatcaaattgacgttttattggcgaaaggggttaaagctctggcgattaacctggtcgacccggcagccgccggtacggtgattgagaaagcgcgcgggcaaaatgtgccggtggtgttctttaacaaagagccttcccgcaaagcgctggacagctatgacaaggcgtattatgtcgggactgactctaaagaatccggtgtgattcagggcgacttgattgccaaacactggcaggcgaatcagggttgggatctgaataaagacggtaaaattcagtatgttctgctgaaaggcgagccggggcacccggatgctgaagcccgtacgacgtatgtggtgaaagagttaaatgataaaggtattcagaccgagcaactggcgttagacaccgctgtgtgggataccgcgcaggcaaaagataagatggatgcctggctgtctggcccgaacgctaacaagattgaggtggttatcgcgaataacgatgcgatggcgatgggcgcggtagaggcgctgaaagcgcataataaatcgtcgattccggtctttggcgtcgatgcgttaccggaagctttggcgctggtgaaatcgggcgcgatggccggtacggtactgaatgacgccaacaatcaggcgaaagcgacattcgatctggcgaaaaacctcgccgaaggcaagggcgcggctgacggcaccagctggaagattgagaacaaaatcgtgcgcgtgccttatgtcggcgtggacaaagacaatctgagcgaatttacccaaaaataacttttccgtctgtgggcgcaattttgttgcgccctgaaaccgtggaagggtgacgtgccgcagaccggataacgtatttcttttgccatccggcgcggatagtcataattaaaaaggccgacagggtatcattatgggcagcacgatctctccgtcgtcgggtgaatatttgttggaaatgcgtggcattaacaaatcatttcccggcgtgaaagcgcttgataatgtcaacttaaacgttcgtccgcactctattcatgcattaatgggcgaaaacggcgcaggcaaatcaacattattaaaatgtcttttcggtatttatcaaaaagactccggcagcattgtatttcagggaaaagaagtggacttccattcggcgaaagaagcgctggagaatgggatttcgatggtacaccaggagttaaacctggtattacaacgttcggtcatggataacatgtggctggggcgttatcccaccaaaggtatgtttgtcgaccaggataaaatgtaccaggataccaaagcgatatttgatgagctggatatcgatattgacccgcgcgcgcgtgggaacgttatccgtttcgcaaatgcagatgattgaaattgcgaaggcgttttcctataacgctaagatcgttattatggatgaaccgacctcatcgttaactgagaaagaggttaatcatctgttcaccattattcgcaagctgaaagaacgcggctgcggcattgtttatatctcgcataaaatggaagaaatttttcaattgtgcgatgaaattactatcttgcgcgacggtcagtggattgccacccagccgctggaagggctggatatggataagatcattgcgatgatggtcgggcgttccctgaaccagcgctttccggataaagaaaataagccgggcgacgtgattctggaggttcgtcacctgacctcgctgcgccagccttccattcgcgatgtctcctttgatttgcacaagggcgaaattctgggcattgccggtctggttggggcaaagcgtaccgatatcgtcgaaacgctgtttggcattcgtgagaagtcgtccgggacaatcactttacatggcaagaaaattaataatcacactgcgaacgaagcgattaaccacggttttgcgctggtgacggaagagcgtcgttccaccggaatttacgcctatctggatatcggatttaactcattaatttcgaatatccgtaattataaaaataaagtggggttactggataattcccggatgaaaagcgacacccaatgggtcattgattccatgcgggtaaaaacgccggggcatcgcgcgcaaattggttcactttccggcggcaatcagcaaaaggtgatcattggtcgctggctattaacgcagccggaaatattaatgctggacgaaccgacccgcggcattgatgtcggcgcaaaatttgaaatttatcagcttattgcggaactggcgaaaaaaggcaaggggatcatcattatatcttctgaaatgccggagctgttagggattaccgatcgtatcctggtgatgagtaacggtctcgtttccggcattgtcgatactaaaacaacaacgcaaaacgaaattttgcgtcttgcttctttgcacctttaagatcaggggctccttatgagtgcgttaaacaagaaaagctttttgacctggctgaaagagggcggaatttacgtcgttcttttagtgctgctggcgattattattttccaggacccgacttttttaagtttgctgaatttaagtaatattctgacgcaatcttcggtacgtattattatcgcgctgggcgtggcgggactcatcgtcacccaggggacagacctgtcggcggggcgtcaggtagggctggcggcggttgtggcggcaacattactgcaatcaatggaaaacgccaacaaagtgtttccggaaatggcgaccatgccgattgcgctggtcatcctgattgtctgcgcgattggcgcggtgattggcctggtgaacggcatcatcattgcttacctgaacgtgacgccgtttattaccacgcttggcacgatgattatcgtttatggaatcaactccctttactatgactttgtcggcgcttcgcccatttccggctttgacagcggcttttccacctttgcgcagggctttgtggcgatgggcagttttcggctctcctacatcaccttttacgctctgattgcggtagtgtttgtctgggtgctgtggaataagacccgctttggtaaaaacatttttgctattggcggcaacccggaagcggcgaaagtttctggcgtaaacgtggcgctgaacctgctgatgatttatgcgctctccggcgtgttttatgccttcggcggcttactggaagcagggcgtattggttctgccaccaacaacctcggctttatgtatgaactggatgcgattgccgcgtgcgtggtcgggggcgtatcgtttagcggcggagtggggacggtcttcggcgtggtgaccggcgtcattatctttaccgtcatcaactatggcctgacctatatcggggtaaacccgtactggcagtacattatcaaaggcggcattatcattttcgccgtggcgctggactcgctgaaatacgcgcgtaagaagtagttatccagacgtattaccttgcttatcagataacccggcgcagcgaaactgcgcgccgggcttcataccgtgagctacagcgttaacgcgtgttctttttcgccttttttaaatttgacctcgcctaaatcaatacaggcgaccgggcagacatgaccgcacagcagacaaccgacgcatttttccgtattgcaatgcggcgtgtggctgtgttcatcccactccatcgcctgatgaccgccgtcatagcaggagatatagcaacgtccgcagccgacgcatttctcctgattaatccgcggatagacgatatagctgcgatccaggtcttccgccgggataatattgccattcgccagcccgatcatctcctgtaatgaggcaaatccctgatcggccagatagtggctgaggccgctcgccatatcttctacaatgcggtaaccgtattgcataatgcctgtcgtcacctgtagggtcgccgcgcccagcagcagaaattcggcagcgtcttcccaggtttcaatgccgccgataccgctaatcgggaaatcgcgcagttcagggtgcattcgcaactgctggataaaacgcagcgcaatgggtttcaccgcttttcctgaataaccggagatgctggatttaccgttaaccaccggcatcccgattttgcggttcaggtcgatgttagtaatggatttcacggtgttgatggtggcgataccgtcggccccgccgcgtttggcggccagcgcgacttcacacatatcgccaatattcggcgtcattttcgccagcattggcaaagatgaaccgcgttttacggcgcggcagtatttttcaaccagttccgggctttgccctacatcgcttcccatggcgtgcgaggtcatctgcgggcaagagaagttacactcaatcatatccgcgccggcttcttcaaccagacgcgccagttcctgccactgctgctcattttcccccatgatggaagcaatcagcaccttatccggataatcctgttttagccgtcgaatggcggccagattctcttccagcggatgctcagcaatttgctccatgtttttgaaaccaataaaaccggtatcttctttcgtcaggtggtcaaaacgtggagagacttcgttggcaataaaaaaccaatggttttaaaaacgatcccgccccagccggtatcataggctttggcgcacatctcataacaattgcctaccggagaagaagaaaggcaaaacggattgggaaacttaacgccgcaaaaggtaacagacaaatcttttgttaacatgagcaggcctcctctaaataatgatgaatagcctgagcggcttcttttccggtttttaccgcataaacgacggtcttatcacctttaacaatatcgccagcggcaaagatcgccgggtcgtcggtttgataattgtgcgtgtcgataatattatgctgcgcttttatctccgcaaagttatccagtcgcgcgtgctgccccacggccaaaataatattttccgcttccagcgtcagttctcctgagtggcgtacatggtggaaggtcactttatttccgctgacggcgacaggcgtaaaaccatcaataatcgatacgcctaatgcctgcgtgctggtaaattctttttcgctggcggggaattcggctaattcttcccgcgccacgcaggtgacggaaggacagccgagaatttttaacgtactggcgacatccatcgctacgtcgccgccgccaataattaatgcgctacgcggaacgctaatatcgccgtcggcctgacgggcgcgctgtaaaaaatcaacggcaatctctacgtgactggcttgctcaaataacggtaaatcagagccacaggacatcccgacggtcatcagcacggcgcgatattcggctttgagttgcgcaagcgatagcgacccgcccacgtcacaattacatttaatattgacgcccatttctacaatgcgggcaatttcctgatcgagtacgctttgcggcagacgaaatgccgggatgccgtgacgcagccatccgccgggctgcggctgtttttcgtaaatggtgacgtcatagcctaaatgtgtgagcgtcacgcttgcctgcaaacctgccggacccgcgccaataatcgcgactttcccgcgtgttttactcccgggctgataaatctgcatggcagtctgctgttcaaaatcggtaataaaacgttgcaggcgtgcaatatcaataggtttatctattccggaacgtgtacatccgcgctggcataatttttccgtcggacagactctggcgcagacggcgccaagcgcattattttcccggatagtttccgctgcgcctttaaaattgcgaaagtaaatagaacgaataaatttccccggatcggtttgcgccgggcaagcctgactacagggcgcatcgtgacataataaacaacgggaagcctcttttattgccagtaatggcgtaaaaccaggcgtgagttcatccagataattttgttgcggcatataatcttccttaatgcttgaataaattaaggcgaaacgcaaataacgcgttttaatgatctaaaatctaccgccagcctaagcattgaaagaagggcattctgtgaaagaattcacaaaaaaatgaaaccagaatgcaaaacagcatttgttccttatatcataataataactattctcaattttaaagggataataaatagattaacgataaaaaagaagataaataatcattccagtaaataaaaaaccgcaaccggtataaagaaaaagataagaccaatattgtacgggatcggcatggcgataaacataaaccggttttcgcgcatttttgacaactttatctaccgcgtcggttcgccagcctttccaggcctcacgaaagcaaaaaagcgggagtagcagaaaggctaatatgacaaatatcgtctgtacatccatgatcatttcccttttttcttttccagttcaagcaattgttccggcgtaacggccggatacccctgggcgtcatttggcacctgatgctgcgtgggaataggtaccagcgggcctaaaaaacgcggttcgcgtttaaaaatatagagatccgccagcgcgctaaagcgggcgccaaattcgcgcaagcgtactgtcagcatatttttgggtgaaggtaccgcgtaacactgcgcctgaatgcccatatgcaacgcaataaacaaggcgcgttcgcagtggaagcgctgagtgatgataataaagtcgttgatatcaaacactttgcgggtacgcacaatggagtcaagcgtacggaagccagcgtaatcaagcacaatgtccgcaggatcgacgcccgccgcgataaggtctttgcgcatggtcatcggttcgttatagctttgcagggcattgtcgccgctgagcagcaggtaattgactttaccgctattgtaagcgtttaacgcgccctggatacgataacgatagtactgattaatgacacccttgcgatagtatttggctgtccctaacacgacgccaacctggcggtaggggagatcctgtagctcgtcatagatatagggcgctgttttccagctcatccaccgatcgaggccaagcaccgtcaacagcagcaagcttaccaggaccaacaggctgtaaaacacgcgctttaacatgcaggaaactcgataccaggatgaaagtacgatcaggctactgtacccgaagacgtagcgcaagaaaccgccgtctgattgcggagattttcagcatgatttcccttgtatcgggtcgcgggagaggagagtcaggccggataagacgccagtgcgtcgctatccggcacatttgcttagccgagaagcacgcggtcaatattatggcaacctaacgctttcagcgttgcggcggtggcatcccattgaattaatgccgcatcgcctttttccgccagaatcgcgcgctgaatatccgcatagtcatagtcattgagactcagcaggtttagcgcgccttgcagtgggggaagcgtagggttaaaggcggcgttttccgcatagctgccggtgaaaatacggccatctttacattccagcgccacgccgctcggtgagtggctataaggcatatggctcttattggctgccgtaatcgccgcttgcgttagcgtattgcccgttaacgtaaagccatgatcctgctcgtccatcagcagcgttttgatctccagatcttttggcccgaaagcgtcaggcagataatcgcgtaacgtatgcggcgcgcggcccggcagatgaatgcgcagatccagaccgctgttcagctcgttcataaactggcgacagtggccgcaaggcgtgtagttaacggtgacggcggcgagccctttttcgccgcgtagccaggcgtggctaatcgcgctttgttcagcatgcacagtttgttgcatggtggcgcccaggaactccatattcgcgccgaaataccagttgccgctaacgccgcgcgcaatcgcgccgacgttaaaatgggacaaatcggtacgggcgcaggccgccgccagaggtaacagtgcgaaagccagcgcgtcttcgtccagtcccgccgtatttttaagcgtcgagacctgctctgcggtcagcatggcgggaaaatggtggtccgccaggataggggccagcgctgattgcaaattatccgcaagctgggcaaaagcagtttgaaaacgtggatgcatggcgttgcctcataacaatgtaatggaaccgtagtttacgggcctgccatgtcttaatatgtgatctaaatctcattgcttatgcaacttgtgaaacttaaatgaaaaatacgcgacgtatcgcaaattttaacccggtcttttgtcccgtcgttagcgcattaccgccagaatgagcggaaacaaaaagggcgctaccagcgaggtaataatgccgcagatcaccagcgccagggagctaaacgcgccttcctggtaatccagctcggcgcagcgcgcagtaccgagcgcatgtgaggcggtccccattgccagcccgcgtgcggctttagtacggatgtgcatcgcgtttaacagcgtgtggccaaacaccgcgcccagaataccgacaaaaattacgcataccgcgctgatcgcggggatgccgccgatgctgccgcccaccgccatcgcgataggcgtagtcacggatttaggcagtaccgatgccgcgatttcaggcgttgcgcccatcagcaaggcaacggatgttccggtaatcatcgctaccagactgccgacaaaacagatgctaataatggatttccaacgcgcgcgaatctggtgcaactgttcataaaggggataggccagcgccaccaccgccggttgcagcagatcgttaagtacttcgctgcctttgaagtagtgctcgtagggaataccggtcagcaacagaaaaggaataatgactaccattgccaccagcagcggattcagcaacggcattttaaaatgcgccgccagtctgcgggcggcgaaaaataccgccagcgtcagcggtaacgaccaccagatatatgtcatcattttttcgttcccttctgcccaaccactttacgctcaccgtgtatcagatgtgaactccagcttacgaccacaaaaacgaccagcgtactgatagcgcaagagaccaccaccgggccgaattgcgcgcgcagtaagtcaaaatattgcatgaccccaacgccaattggcacaaacagcaatgccatataacgaatcagcacataacagccggggttaacccactttgccggcagaatttgcagcgccagcaatacaaacagaattaacatcccgataatgctgccgggaatagtgataggaagcagtgatgcaagaaaaatgcctgcgtacaaacaggcataaatcaatacaaaagcgcgtatatattgccagataatattcagtgacttactcatgtttaaagcccttgatgagatggattcatcatacaattaaacgttaaaacgtgctaccgatcacatcatgaattcttagcatagtgggtatagacagcaggaacatcgggcaatgcccctggtcggcggcgttaaacctgggctaaaaaatacaaaaagcgactcagggccaaagacggcgtctcattcttacgccagaacatccctacgctgcctttttgctcaatttttggcaagtttaaaatcgccagttgcccctggctggcatagcgttgcgccagccgtaaagaaagaatagagatcatatcgctgctttgcagcaaattggtgctgacgttcattgacgccgattcaatggtgttttccgggagcatgacgccattatcgacgagggcgttatcaatactgatgcgaataggggtgccggttggccagactatccaccgccagtgtgccagatcgctccaggcgatctgcgctcgcgcggccagcggatggtgcggacgcgccacaaagcagaccggctcggtataaagtacctgataattaagcggcagttgcagggcgcggccgccgacacgccctaccaccacatccacctgaccggcaagcaaatcgtgcagcagcggcgtcattaccttctcttcaatattcagatgcagcgtcggcatttcgttaagcaggctcagaatcgcctgtgatacgcagtcagtcgccacgggcgaacagccgatcttcaggctgccaaccaggccgccctgcttgaaacgggcgatttcatactgtgaacgctccagatcgttaattaggcgctgggcgtgctggagcagtaatttaccgccttccgaggggcgtagtcctttactgtggcgctcaaaaagcgtgatgcctatctcatcttcgagttgagatagccacttcgatagcgccggctgggagatattcatcatccgggcgacgtgcgtcaggttgccctgttcgcccagcgcaaccagcgtttgcaggtgatgtaatttcaatttctgcgcccagttcgccattcgctataacctccaggttatgtctctgcctgaaaagccattgtacattttatcgctcactctacaaactcgtaacatagcaaacataaaaacaacatctatctccctgcactgaggcattagctatgactcaacgacgtgatctacaagcccttattgatgccgcgcccgtcggcaaaatgcagtggcgcgttatcatctgctgttttctggtggttatgctcgacggtttcgacaccgccgcgattggcttcatcgccccggatattcgtactcactggcagctaagcgccagcgaacttgcgccgctgtttggcgcagggctgctggggcttacggccggcgcgctgctatgcgggccgctggcggatcgctttggccgcaagcgggtcattgagctttgcgtggcgctattcggcgcattgagcctgctttccgctttctcgccggatatagaaaccctggtgttgctgcgcttcttaaccggtctgggactgggcggagcgatgccgaataccatcaccatgacgtcggaataccttcccgctcgtcgacgcggagcgctggtcacgctgatgttctgcggttttaccctggggtcggcgatgggcgggattgtgagcgcgcaactggtgccgctgattggctggcacggaattctggcgctaggcggcatcttgcctttgatgctgtttttcggcctgctgttcgcgctgccggaatctccccgctggcaggtacgtcgccaactaccgcaagccgttgtcgcccggacggtcagcgccattaccggcgagcgctatcacgatacgcaattctttctgcatgagacggcagccgtcgccaaaggcagtattcgccagctttttgccgggcgacagcttgtcattaccctgatgttatgggtggtgttctttatgagcctgctcattatctatctgctttccagctggatgccgacgttacttaaccatcgaggtattgatctgcaacaggcgtcgtgggtgactgccgcattccaggtgggcggcacgcttggcgcgctgttactcggcgtgttgatggaccggcttaacccgttccgggtactggcggtgagctatgcgctgggcgcagtttgcattgtcatgataggcctgagcgaaaacggcctttggctgatggcgctggcgatttttggtaccggcatcggtattagcggttcccaggtcgggctgaatgctctgacggcgacgctgtaccccacccaaagccgggcgacgggcgtgagctggtcgaacgccattggacgctgcggggcgattgtcggttcgctctccggcggcatgatgatggccctcaatttctctttcgatacgttgttttttgtcattgctattccggcggctatcagcgcggtaatgcttaccctgctgacagtggttgtccgcctttcgatttctgtacctgacgacctgccgcgtgccagcgtcgtaaacgaataaggagaatctccatgtctgaaataaatcagaacgtaaaagatagccgtcagcagtattaccagcatatttccgggcagaatctgacgccgctgtgggaatcgttacatcacctggtaccgcagacgccaaacgccaactgcgcgccggcctactggaattatcaggaaattcgtccgctactgatggaaagcggcaatgtcattggcgcgaaagaggcgatccgccgggtgctggtgctggaaaatccggcattgcgcggtcagtcgtcgatcacggcgaccttatacgctggtttacagctgatcctgcccggcgaagtcgcgccgagtcatcgccataaccagtcggcgctgcgttttatcgtcgaaggtaaaggcgcatttaccgcggtggacggcgagcgcacgccaatgcataccggcgattttatcctgacgccgcagtggcgctggcacgatcatggtaatccgggatcagagccggtggtatggctggatggtctggatctgccgttagtcaatctcctgggctgtggttttgcggaagactatcccgaagatcagcagccggtgacgcgaaaagagggcgattatctgccgcgctatgcagcgaatatgctgccgctgcgccaccagcgcgggaactcgtcgccgattttcaactaccgttacgaccgcagtcgcgaggcgttgcacgatctgacccgtatgggcgatccggatgagtgggaaggctacaagctgcgttacgttaatcccgtcactggcggttatccgatgccgtcgatgggcgcgttcctgcaactgctgccaaaaggctttgcctcgcgtgtggcgcggagcaccgacagcactatctaccacgtcgttgaaggggcagggcaggtcactatcggcaacgaaacttttcatttttccgcaaaagacatttttgtggcgccgacctggcatgaggtgtcgtttcgcagcagcgaagacacggtgttattcagcttttcggacaagccggttcaggaagccctggggctgttccgcgaagcacgttattaattagggagagagaacatgaccaaatatgtattccagccgcaggccccggtgacagtacccgtggcgggcagtgatgagcagtttccggtacgtcgcgtttactgcgtgggtcgcaactatgccgcccatgcccgtgaaatgggttttgatcccgatcgcgaaccgccgttcttcttttgtaaaccagcggacgctgtcgtcccggtagcggcgggggataccctggaactgccgtatccggcgcagaccgataactaccattatgaaattgagctggtggtggcgattggtaaaaaggggagcgatatcccgctagaaaaagcccatgaatatgtctggggatacgccaccggtctggacatgacgcgtcgcgatcgtcagatggaaatgcgtcagatgggacgcccgtgggaaattggcaaagcgttcgatctctccgcgcccattgcgccattacacaaagccgctgaaacgcataatgtggataacgcccctatttggttacaggttaacggcgaagaccatcagcgcagcgatattcgtcatctgatttggtcggtgaatgaaaccatcagctatttgtccggcttttttgaattgcagccaggcgatttgattttcaccggtacgccagagggggtgggcgcagtggtgaaaggggatgtcatcaccgggaacgtagaaggtctgacgccgattgctgtgaaaattgtctgaggtgaacgatgaagctgtacagtttctttaatagttcggcgtcttatcgtgtacgtattgcgctggcgttaaaggggattgattaccagacagtgggcgtcaatattcgtatcggccagcagaatgcgctggcctaccgacggatgaatccggtaggcctggtgccgacgctagtcactgatgacggcgaatcgttggggcaatcgctggccatcgtcgactggctggaccgacattttccgcaaacgccgctgctgccgacgagcgacccggcgcgcagccaggcgctggaaattgtctacgctatcgcctgcgatatacacccgatcaataacatgcgcgtgttgcgctacctgaccgatgagctgaaggttagcgaagaggataaaaaacgctggtacgcccactggatacagcaagggttaagcgcggtagagcagctattgcgtaaaagtcagtccggacgattctgcgtgggcgacgcgccaggccttgcggactgctgcctgattcctcagtgggcgaatgcgctcaggatgggctgcgatttatcaggctatccgcgctgtaaagccgtttatgacgcctgcgtacagctaccggcgtttattgccgccgcgccggaaaatcaacaagataaaatcccggcctgaaaaggagaatgaccatgactcacgtgacaagcgcaattattgtaggtggcggaatcggcggcgcggcgaccgcgctgtcgctggcgcgccagggaataaaagtcatgctgctggaaaaagcgcacgaaattggcgagattggcgcgggtattcagcttgggccgaacgctttttcggcgctggatagtctcggtgtgggcgatgttgcccgccagcgtgcggtgtttaccgatcacattaccatgatggatgccgtgaatgccgaagaagtggtacgcattgaaaccgggcaggcgttccgcgaccattttggcgggccgtatgcggtaattcaccgggtagatattcatgcaacggtatgggaagcggtgctgacgcaccctggcgtggagtatcgtacctcgacccatattgtcgatatccgccagacgccggatgacgttacggtgtttgatgagcagggaaatagctggacggcggatattctcgtgggctgcgacggcgttaaatcggtcgtgcggcaaagtttactcggcgacgcgccgcgcgtaacggggcatgtagtctatcgggcggtgattgattgcgacgatatgccggacgatttacgtattaacgcaccggtgctgtgggcaggcccgcattgtcacctggtccattatccgctgcgcggaggccaacagtacaatctggtggtgacattccacagccgccagcaagaagagtggggcgtgaaagacggcagtaaagaagaggtgctctcttattttgccggtattcatccccgcccgcgtcagatgctggataagccgacctcctggcgccgctggtcgaccgccgatcgcgagccggtcgcaaaatggggaaccgagcgtatcactctggtgggcgacgccgcgcatccggtggcgcaatatatggcccagggcgcctgtatggcgctggaagacgccgtcacgctaggcaaagcgctggaacgctgcgacggcgacgcgcagcaggcatttgcgctgtatgagtcggtgcgtattccccgcacggcgcgtatcgtctggtctacccgcgagatggggcgtctctatcacgccgccggggtggagcgtcaggtgcgtaatctgctgtggaaagggaaatcgcaggaggcgttttatcgcggtatcgaatggctgtacggctggaaagaagataactgtcttgagccgcgttgagcgccttacgtgacgtagcgtggcgtttgcgccgccacccggcaaaaagttttgctcatcgcagagaggcgttatgatagcgcctctttttttgctgtggataccgatatgcgtgttttactggcgccgatggaaggcgtgctcgacgcgttagtgcgcgagctgctgaccgaagtgaatgattacgatctctgcatcaccgaatttgtgcgcgtggtggatcagctgctgccggtaaaagtgtttcatcgcatctgcccggagttgcttcacgccagccgcacgccgtccggcacgccggtgcgtattcagcttctgggccagcatccgcagtggctggcggaaaacgccgcgcgggcgacggcgttgggatcgtatggcgtggacctgaactgcggctgtccgtcaaaagtggtgaacggcagcggcggcggcgcgacattgctcacagatcccgaactcatctatcagggcgcgaaagcgatgcgggccgcggtaccgtcgcatctgccggtgacggtaaaagtgcgtctcggctgggatagcggcgatagaaaatttgaaatcgccgatgcggtgcagcaggccggcgccagtgaactggtggtgcatggccgtaccaaagcgcagggctaccgcgccgagcatatcgactggcaggcgatcggcgaaatacgccagcgtctgactattccggttatcgctaatggcgaaatctgggactggcagagcgcgcaggcatgtatggcgaccagcggctgcgatgcggtgatgattggccgcggggcgttaaatattcctaacctgagccgggtggtgaagtataacgaaccgcgtatgccgtggccggaagtggtaacgttattacaaaaatatacccgactggaaaagcagggcgataccggtttataccatgtcgcgcgtattaaacagtggttgggatatttacgtaaggaatatattgaggcgacagaactctttcagtcgattcgggcgttaaaccgttcgtccgagattgcgcgggtgattcaggctattaaaatctaatctctacagcgtccagaacgtgtgccgggcagatactatcgctgcccggcgcaggaatcagaaaatcatcttaaacacgcccgttaccaccaacagcccaatcagaaaaataattaagattgcccatagaagaattttcattgtttgtccctttattggtaaatacaaacaaagtataggaaagtattaagccatctgctgctttgttgggcgcggcgacgtttaactcatgaaggctgctggcgcgtattgcagcaaaatcgttcatttatgaacgggttagtgggacttttcattgaagtattacatcaaaaaatgtatcagatgaaattatttgctaatcatataaatttcaaaatatgtcttttgttgtctgatgatgtattgccacgcgtaactaaaaaatagttcgccgtaagacgtactctctgcgcacctttttttatcagaacacctccatgaatcgtaattctttccttgccgcgacagcgagcttaccgctttttattttgctggcgggctgcgcccctatgcacgatacccgccagtcgctgacccagcagacgccctcttctcatgttgattccagcctgccggcggcattgaaaaacggttggccggatagctagtggtggaaggcgtatcacgatgcgcagcttgacgcgctgattgataatgccatacagcattcgccggatatgcaggtggctgaacagcgtattcaactggcggaagcgcaggcgaaagcggttgaggcgcaggacggcccgcagctcgacttttctgccgacattgagcgccagcgaatgtccgcggaagggctgatggggccattcgcgattaccgaccccgcggcgggaacgaccgggccgtggtataccaacggtacattcggcctgacggcgggctgggatctggatttatgggggaaaaaccgcgctgaagttaccgcgcggatcggggcggtcaaagcgcgcgaagcggagcaggagcagacccgacaattgctggcaagcggcgtggcgcgactctactgggagtggcagacgcaggcggcgctgaaaaatgtgctgatgcaaatcgagcatgagcagcaaaacgtggtggcggtaaaccgggagctgtatcaacacggtattacttcttctgttgaaggggtcgagaccgatatcgacgccagcaaaacccagcagcagttgaatgacgttaacggtaaaatgaaggttattgaagcgcggctcagcgcgttaaccaatacgcaatcggcggcgctcaagctgcgtcaggtgagtctccccgccgttgaaagccagttaccgtcgcaactggggtattcgttgctggcgcgccgggcggatctacaggccgcgcactggtacattgaatcctcgttgagcagcattgacgccgcgaaggccgcgttttatcccgatatcaatctgatggcttttttacagcaggatgcgttacatctgagcgatctgttccgccattccgcacagcaatatggcattaccggcgggctgacgctgccgattttcgacagcggcaggctgaatgccaacctcgatatcgccaaagcgcaaagcaacctttctatcgccaactacaacaaagcggtggtagatgcggttaatgatgtggcgcgcgccgccagtcaggtagagacgctggcgcagaaaaatcagcatcagcagcagattgagcatgacgcgcagcgtgtggtcggtctggcgcaagcgcgctttaatgccggcattattgcgggttcccgcgtgagcgaggccaaaatcccggcactgcgcgagcagtgtaacggcttgctgttgcagggccagtggctggatgcctctattcagcttaccagcgcgctgggcggcggttatcattcctgatttttccagatgattcagacagggttcctatacttaggctgtgtatgattcatccggagaggaatatgaccaaagtcgcaattgtaacggcatcagattcgggaattggcaaagcgtgtgcgttgttattagcacaaaacggttttgatattggtatcacctggcattccgatgaacgcggcgcgcaggagacggcgaaaaaagcggcgcagtttggtgtgcgggcagagaccattcatcttgacctgagccagttacccgagggcgcgcaggccattgaacatcttatccagcgcctggggcgcgttgacgtgctggtcaataatgccggggcgatgaccaaatccgcgtttattgatatgccgtttacgcagtggcggcaaatttttaccgtggatgtcgatggcgcgtttctctgcgcgcagatcgccgcccggcatatgattaaacaaggagagggagggcgcattatcaacatcacctccgtccatgagcatacgccgcttccgcaagccagcgcctataccgcggcgaaacatgcgttggggggattgactaaatccatggcgctggaactgattgagcatcatattttggtcaacgccgtcgcgccaggcgctatcgccacgccgatgaatgatatggatgacagcgacattgagccgggatcggaaccctcgatccctatcgcccgaccgggttctacgcatgaaatagccagcctcgtcgcctggctgtgttcggaaggcgcaagctataccaccggtcagtcgctgattgtcgacggcggatttatgctggtgaatccgcaattcaacgcaaaataaacgccggggccggatggcggcgttatgccatccggataccatcgggtttaacgggcctccgctttgccgcgtcttttcagccaccagcgcacgcccaccaccaggacgatggccagaatcagccagactccgtgcctgagatgctgatcgaggtcgtgcagccatggcgcgatcacctcgccgccaagatatcccagcgtggtaaacagcagcgcccagatcagcgcgcctacaatattcagcggcagaaaaattttaggcggcaggcggctggcgccaatcagcagcgggccaaccacccggaagccatacataaaacgcgtgccgatcacaaacagatacggatggcgttggatcattttctgcgcgcgacgaatcttcgtatgataacgcgggaaacgacgcaggatcttcccgccatagcatcgtcctaacaggtaaagtagctgatcgcccatcatccctcccagcgcgacggccgccgccaccagcggaaacttgagtaatccctgatgcgccgcgacgccccccaacagggtaacggtttcaccttcggccatactgccgataaccagcgccgcatagccataatgcgtaataagcgtgttgatatccatgcgtaaaccacctccggcattaagcatacaccctggcaagaggcgtgcgcggcaaagccgacgttttgccggagactattttgccattgctcataaaataaccagaaactgaattatacttgaacatactggcatctgaggcagcagaagggggcagtatgaaccatgtatgggggcttttttcccatcccgatcgggaaatgcaggtgatcaaaagcgaaaacgaaaccgtttcgcatcactatacgcaccatgttttgctgatggcggcgattcccgtcgtctgcgcctttatcggcacgacgcaaatcggctggaattttggcgacggcaacgtgttacaactctcgctgtttaccgcttttgcgctggcggtcttgttctacggcgtgatgctggcgggcgtcgcggtgatgggacgcgtcatctggtggatggcgcgaaactatccgcaacggccatcgcttgcgcgctgtatggtttttgccggctatgtcgcgacgccgctgtttttaagtggtctggtggcgctctatcccctggtatggctatgcgctttggtcggcgctgtcgcgcttttttacaccggctatttgctgtatttgggtattccgactttccttaacattaatagagaggagggattaagcttctccagttcgacgctcgctatcggcgtactggtcctggaggtgctgctggcgatcaccgtgatcctgtggggatatggctaccgcctgttctgatgcgaaaaagggctggcgcaaaagccagcaatgcagcatttgctgacgattcttctgtagcggcaacgctggcgtgccgctatgatgccactgctagcttgagtataatcttagctcaggcggtgtgcgttacgacgcgcgtgaatcattatcagaaatctcatcatgctgaaattctgagcttcattcctgagccttgctctgatgttggccgttccttttgccccgcaggctgtggcgaaaacggcagcgacaaccgcggcgtctcaacctgagattgcctccggtagcgcaatgattgttgatctcaacaccaataaagtgatctattcgaaccacccggatctggtgcgtccgattgcctcgataaccaaattaatgacagcgatggtcgtgctcgacgcgcgattgccgctggatgaaatactgaaggtcgatatcagccagacgccggaaatgaaaggggtttactcccgcgtgcgcctgaacagcgaaattagccgcaaaaatatgttgctgctggcgttgatgtcatccgaaaaccgtgcggcggcaagcctggcgcactattatcccggcggttataacgcatttattaaagcgatgaatgcgaaggcgaaagcgctgggcatgacgcatacccgctttgttgagccgacggggctgtcgattcataacgtctcgaccgcgcgggatttaacaaaattgctgattgccacgaagcaatacccgctgattggccagctaagcaccacgcgcgaagatatggcgacattctcgcatccggcgtatacgctgccgtttcgcaataccaaccatttggtctaccgtgataactggaatatccagttaacgaaaaccggctttaccaatgcggcggggcattgcctggtgatgcgtaccgtgatcaataacaaaccggtcgcgctggtggtcatggacgcgttcggcaaatatacccactttgcggacgccagtcgcctgcgtacatggattgaaaccggtaaagtcatgcccgttccggctgccgcgctgagctataaaaagcaaaaagccgcgcaaatggcggcagccagcgccagcgccggagcgcaaaccgcacagaacgattaagtcgccgcaggcccggcaggcatcgcgccgccgggcattcacggtaaaccacaccgtgttaatgcgtttcgtcgggcgtattttcctgccagaatttccgcttactcgttttgccgataccggggttcatactgttggttgggtcattttgccgataaaaacgcgtcagcgtttccggcgctttatacagatgtccaacgttgtgctccgccgggtattgtgccccgcgcgcctgcaacagctccagcatttgcgctttcagcgcatggacgtcgacgcctttcttcacgatatagtcctgatgaaaaacgtggcacataaagtgaccgtaatagagtttatgtaccagttggctgtcgatttccggcggcagatgctcgaaccagtcggtatcgttgcggcgcagggcgatatccagcgccagaatatcttccacttcatcagcgtgtacggcctgataacgaatcgctgcgccagcagcggcgaagcggtgcaggaaggctttgctgccttcttccggcgtacaggtgaagaaaccgccctcagcggatttaaaaaattcattcagccagcgttgcgcttctgcgacgccgtctcccgccatttttaacagcagatgatgctcatatttatcgcgccagtttttcattcgcggcggcagatggctgggaaacagatggccgaatttctgcatcgcgcggtcggtgaaatgcggtcggaaaaattttactttttccagcatcgcatcggttcggccttttagcgtgaaaaagaatggcatcttgtcggtgccgagtttatcgatcatcagaaaggtatctttaccgtactgctccgcaatatcgtagatatcgcgatgcatatattctcccgccactggcagattgtcgaagttcgccagaatatgccgacggatttcagtcagtaccgcgggctgattggtgccgatataaaaaacctgctgatttttttccgctgcaaaggtatcaaggcgaacggcaaaaaccgccagttttccggcgcagccggaagattcaaacaaacggtccgggtcggcgttatagcgggcgggcgtatcggcgttgatatctcgtacccgcgtcacgtagtcgtgatcgtgcgcatgacgaccatcgtgacgcacatcctcatctttaatccgttcatcatccagcttgctcaggatctgctccggcgtatgcccaagatcgatacccagatgattgaccagttgcagtttgccttgctcgtcaatacgggcaaagagcgacatctcggtataggccgggccgcgctgcaccagcgagccgccggagttattacagatgccgccgatgaccgacgcgccgatacacgacgaaccaatcaccgagtgcggttcacggcccagcggtttaagcgctttttccagcgcatagagcgtcgtaccgggccaggccagaacctgttggccgttatccagtaagtgcagcttatccagccgctgggtgctgataatcacaatatcgcgatcgtagtcgttgccgttcggcgtggagccttccgtcagaccggtgttggcggcctgcatcagaataattttgtcagcgttaacgcaggcgttgagcacacgccacagttccagtaatgaacccgggaaaacaacggccagcgcgtcgccctgaccggaacggaaacccttgcgatagcgggcggttttggcggggtctgtcagcaggtgagaatggcctaccaggcgggccagctcattcaggaacgttttattatcagtcattgttatggaagacattctccactccttgtggtgggacaaaatatcagcgttaagcatagcgctttgtatgacaatacgctttctcattcaaattgtttctgtgttggtggtattcatttgccgccttgataccatttgctggcggttgcgtattcgactgtgcggaaaattaggagaataaccttcgctttcttctcctctcgcgtttaggcttatggcaaactgcggtttttattctgtttttaccgcctcgtcgggataaagataaagagagactcaacatgaaatggttatgttcagtaggtgttgctgtgagtctggcgatgcagccagcattggcggaaaacctgtttggcaatcacccgctgacgcccgaagcgcgcgacgcgttcgtcacggatttactcaagaaaatgactgtcgatgaaaaaattggtcagttacgtctgattagcgtcggccctgataacccgaaagaagcgattcgcgagatgatcaaagacgggcaggtaggggcgattttcaataccgtcacccgccaggatatccgtcaaatgcaggatcaggtgatggcattgagccgcctgaaaattcctctcttttttgcttatgacgtggtacacggccagcgaaccgtcttcccgataagcctcggtctggcttcttcttttaatctggatgcggtaagaaccgtaggacgcgtatcggcgtatgaagcggcggacgacggtctgaatatgacttgggcgccgatggtggatgtctcccgcgatccgcgttggggacgcgcctccgaaggctttggcgaagatacatatttaacctccatcatgggcgaaaccatggtgaaagcgatgcagggcaaaagcccggcggaccgctattcggtgatgaccagcgtgaaacattttgccgcctatggcgccgttgaaggcggtaaagaatacaacaccgtggatatgagttcccagcgtctgtttaatgactacatgccgccgtacaaagcggggctggatgcggggagcggcgcggtgatggtggcgctgaactcgctgaacggcacgcctgcgacgtcagattcctggctattgaaagatgtcctgcgcgatgagtggggctttaagggaattaccgtttccgaccacggcgctattaaagaactgattaaacacggtaccgcggccgacccggaagatgcggtgcgcgtggcgctaaaggcaggggtggatatgagcatggcggatgagtattacagcaaatatctgccgggtctgattaagtcgggcaaagtgacgatggcggaactggacgacgcgacgcgccatgtgctcaacgtaaaatatgacatgggattgtttaacgacccctatagccatctgggaccgaaagagagcgacccggtggacaccaatgccgaaagccgcctgcatcgtaaagaggcacgggaagtggcgcgggaaagtgtggttctgctgaaaaaccggctggaaacgctgccgctgaaaaaatcgggcaccattgccgttgttgggccgctggccgacagtcaacgtgatgtaatgggaagctggtctgctgctggggtcgcgaatcagtcagtgacggtgctggcgggtattcaaaatgccgtcggtgacggggcgaagatcctctatgccaaaggggcgaatatcactaacgataaagatatcgtcgatttcttaaacctgtatgaagaggcggtgaaaatcgatccgcgctcaccgcaggcgatgattgatgaggcggtgcaggcggcgaaacaggccgatgtagtggtcgcagtggtaggcgagtcgcaggggatggcgcatgaagcctccagtcgtaccaatatcaccattccgcagagtcagcgcgacttaatcaccgctctgaaagccaccggtaagccgctggtactggtattaatgaacggcagaccgctggcgctggtaaaagaagatcaacaagccgatgcgattctggagacctggtttgccgggacggaaggcggcaacgccattgccgatgtgctgtttggcgattacaacccgtcaggcaaactgccgatctccttcccgcgttcggtgggacaaattccggtctattatagccatctcaatacgggacgcccgtataatcctgaaaagccaaacaaatacacctcacgctattttgacgaagcgaatggcccgctctatccgtttggttacggtctgagctacaccacatttacggtgtctgacgtcacgctctcctcaccgacaatgcaacgcgacggcaaagtcacggccagcgtagaggtcacgaataccggtaaacgcgaaggggaaacggtcatccagatgtacttacaggatgtcacggcgtcgatgagccgcccggtgaagcaattaaaaggctttgaaaaaatcaccctcaagcccggcgaacgtaaaaccgtgagtttcccgattgatatcgaggcgttgaagttctggaatcagcagatgaaatatgacgcggaacccggcaagttcaacgtctttatcggcgtggattccgctcgcgttaaacaaggatcgttcgagctactgtaagcctgccgtcaacagggcgcgatagcagcgccctgtctggcaatgactttttctgtcccccccttttattgcctgccacgtcacttaaactgccggaaaatcccaggttaaacgcagacttttcaactatgcttttttctcaagtttctgaaaaaggccgtaaaaggatgaggaaagcatcatgacgatctcaaagctatgggtaagttcgctggcgttgctggcgacggtgagtttacctctacaggcggcatcgcccgtgacggtcgggtcaaagattgataccgaaggcgcactgctcggcaacatgattttgcaggtactggaaagccacggcgttaaaacggtcaataaaattcagctcgggacgacgccagtcgttcgtggcgcgattaccgccggagagctggatatctatccggaatacaccggtaacggggcgttcttttttaaagatgaaaacgatccggcatggaaaaatgcaaagcaaggctttgagaaagtcaaaaaactggatgcggagcagaataagctggtctggttgacgcctgcgccggccaacaacacctggaccatcgcgatacgtcaggacatcgcggaaaaaaataaactctcctcgcttgccgatctcagccgttatctgaaagagggcggcacttttaaactggcggcgtctgcggaatttatcgaacggtcggatgcgctgccggcatttgaaaaagcctatgattttaccttgaatcagaaccagctcttgtcgctggcgggcggcgatacggcggtcacgatcaaagccgccgcgcaacaaacatccggtgttaacgccgcgatggcgtatggcaccgacggcccggtcgccgcgctgggtctgcaaaccctgagcgacccgaaaggcgtccagcctatctatgcccccgcgccggtagtgcgtgaatcggtgttacaggcctatccgcagatagccgattggctgcagcccgttttcgccagccttgatgagaaaacgctgcaacagttgaacgccagaatcgccgtagaagggctggatgcgaaaaaagtcgccgcagattacctccgacaaaaagggtgggtgaagtaatctgtgagtgacgctgccaaaaaaattacggttaatcgtgtgctgttgctgttggttgttctggccctgcttgctgtcgcgctgcctttcattaattacgccccgaatcgtctggtgagcggcgaggggcgccagttatgggagatctggccggcgaccatctggatgctgactggcgcgggatgcgcgctgtttacgctgtgctttgtgcccggtaaacgcggtagcgtactgacgctgatgatggcgcagacgctttttattgtcatgctgtggggagtcggcagggcggcgacccagttggcgcaggagggcagtccgctggcgcgtaccagtctgggaagtggattgtggctgggcctcggtctgatgctgctggcctgtagcgatgcgatccgccgtattaccgttgggccgctgtggcgctggttgctgcacgcgcaaattgtcattgtcccgctggcgctgctgttttcaggcacgttcgacaacctctcgcttctgaaagagtataccaaccgccaggatgttttcgatgccgcgctggtgcaacatttaatgttactggcgggcacggtgctgccggcgctggcgatcggactaccgttgggcgtctggtgttatttttccgcctcacgccaggggccggtgtttaccgtactgaatgtgatccagactattccttccgtcgcgctgtttggcctgctgatcgcgccgttggccgggctggtgaaacagtttccgtggcttgccgaattcggcgtcgcgggaaccggcatgacgcctgcgctgatagcgctggtgctctatgcgttattgccgctggtgcgcggcgtggtcgccgggctcaatcaggtgccacgcgatgtgctggagagcgcaagagcaatgggaatgagtagcggccagcgcttcaggcatgtgcaactgccgctggcgctgccggtctttttacgtagcctgcgggtagtaatggtccagacagtgggaatggccgtcgccgccgcgctgattggcgcgggaggtttcggcgcgctggtgtttcaggggctattgagcagcgccattgatttagtcctgttgggcgtcattccggtgattgcgctggcggtagtgatcgacgcgctgtttgatttatggatcgcgtttttgaagggagcaaccgatgattgaatttaaccatgtcagtaaaaccttcggcgatcaacaggctgttagcgacctcaatttgcactttagcgaaggcagcttttcggtgttaattggcacctccggttcgggaaaatcgaccactctgaagatgattaaccggctggtagagcatgatagcggaacgatccgttttgccggtgaagagatccgcagcctgccggtgcttgaactgcgccgtcgcatgggctatgccattcagtctatcggcctttttccccactggacggtggcgcaaaatatcgccaccgtaccgcaactacaaaagtggtcgcgtgcgcggattaacgatcgtattgatgaactgatggcattattgggtctggaaagcgcgctgcgcgatcgctatccgcatcagctttccggcgggcaacagcagcgggtcggcgttgcgcgggcgctggctgccgatccgcaggtattgctgatggacgagcctttcggcgcgcttgatccggtaacgcgcggcgcattgcagcaggagatgacccgcattcatcagctactggggcgcaccatcgtactggtgacgcacgacatcgacgaggcgctacgcctcgccgaccatctggtgctgatggacgggggccacgttatccaacagggatcgccactttctatgctgacctcgccggaaaatgatttcgtgcaggcattttttggccgcagcgagctgggcgtaaggctgctttcgttacgtagcgtaggcgattatgtacgtcggcatgaacagctcagcggcgacgcgctggtggaagagatgacgctacgcgatgcgctatcgatgtttgtcgcccgtcggtgcgacgtcctgccggtggcgaatcagcagggcgagccctgcggtacgctccatttccgcgatctgctttcggagacgtccccccgtgaaacgactgtgtgatccgcttctctggcttattgttctgttcttgcttctgctgtttggattgccttatagccagccgttcttcgccgcgctgtttcccgatttaccgcgcccggtctaccaacaggagagttttgccgccctcgcgctcgcccatttctggttggtgggcatctcaagtttgtttgccgtcgtggtgggcgtcggcgcagggattgcggtcacgcgagaaagtgggaaagagtttcgtcccctagtggagactatcgccgccgtcgggcagacctttccgccggtcgcggtactggcgatcgcggtacccgtcatgggttttggtcagcaaccggccattatcgccttgatcctgtatggggtgttgcccatcctgcaggcgaccctggccgggctgggcgcggtgcctgccagcgtgatgagcgttgccagcggtatgggaatgagccgtcgccaacagttgtatcaggttgagctgccgctggccgcgccggtgattctggcgggcatccgaacctcggtgattatcaatattggtacggcgaccatcgcttcaacggtgggggccagtacgttaggcacgccgatcattatcgggcttagcggctttaatacggcctatgttatccagggggcgctgctggtggcgctggcggcgatcattatcgatcgcctgtttgaaaggctgacgcgcgcgcttacccggcacgcaaaataaaactgtaacctgccagcatcacgccgccgataccgccaatagccatcagcaggaaaagggcgatcaccccgattttcgctacgcgcattatgtactccttatgttaataaaaggagtatacattaaagcgaatttgttagctgctgtttaaacgccaaggggatgaatgtcgtgtccctgggcgcgccatgccaggagttgctgctgctgcgccagcgtctggtgttctccgcaccataccagtaacgtcttgccgtcaaaaagttccgggcggaactggctaagcgaatgcgccaacacgtcgattcgccatccctgttggctggcgacccaaccttccagccacaggcgggtggtatcatggatattccagccgatcaccaacgcatcttttccctgtttcttacgcgcagacgccaggcagagcgcaatatagttgatcaggataccgtcaagaatgccgagcagcgcctgaagggcgggttgttggcactgtaatcgtcgccgcagtgggacgaacaggttagtggtcaatgtttgggcaggataatcctgaccgcgttctttgacccataaccgtaaactgtgcagattactgctttgcaggtagtgcagcaggatctcctgctgttcgcgccagccgttaggttgttcgctactgtcgctactgagcagcactttgactttgctgacctggacgccgttatctatccagcgcttgatttcgcggattctgtcgatatcggcatcgttaaacagacgatgaccgccatccgttcgctgtggttttaaaagtccataacgtctctgccacgcgcgcaacgtgacaggattgatatcacaaagcaaagccacttcaccaattgtgtaaagcgccatcgtttcacccttgctcgcgaggtcccggtttaactttagacgctcttttaggaaccaggaagttttgcctgttttttatgcattaaaacgcgaagtagcgggttgcggcgcggcgtttaagtgatcgtattcacgaattcatatttttatgcaacagttcaaagaaagttaatcgtactcaatgtatgttacgcgcttttaattgaagtgtggtttgcgggtatgtacgagtttaatctggtgttgctgctgcttcagcagatgtgcgtgtttctggtcattgcgtggctaatgagtaaaacgcgcctgttcatcccgcttatgcaggtcacggttcgtctgccgcacaagcttctgtgttatgtcacgttttctatcttctgcattatgggcacttattttgggctacatatcgaagattcgattgccaatacccgcgcgattggcgcggtgatgggcggcctactcggcgggccggtcgtcggcgggctggtcggtctgaccggtgggttacatcggtattctatgggcggcatgacggcgctgagctgtatgatttccaccatcgtcgaagggctgctgggcgggttggtacacagcgttctcatacgtcgcggacgcccggacaaagtgtttagcccgctgacggcgggagcaattacgtgtgttgccgaactggtgcagatgctgatcattttactgatagccaggccgtttgacgatgccctgcatctggtcagtaatattgccgcgccgatgatggtgacgaataccgttggcgccgcgctgtttatgcgtattttgctcgataagcgcgccatgttcgaaaaatatacttcggcattttctgttaccgcgctgaaggtcgccgcgtcaacggaggggattctgcgtcagggatttaacgaagtgaacagtatgaagatgacgcaggtgttatatcaggagctggatattggcgccgtcgccatcaccgatcgcgaaaaactgctggcttttactggtattggcgacgatcaccatctaccgggcaaacccatttcatcaggttatacgctgaaagcaattgaaaccggagaggtggtttatgccgatggcaacgaagtgccgtatcgctgttcgctacacccgcagtgtaaactcggctcgacgctggtgatcccgctgcgtggcgaaaatcagcgagtcatgggcaccattaaattgtacgaagcgaaaaaccgactgttcagctcaattaaccgtactctgggggagggtattgcgcagcttttatccgcgcagatcctggccgggcagtatgaacggcagaaggcgttgctgacgcagtcagagatcaagctgttgcacgcgcaggtgaatccgcattttctgtttaatgcgctcaataccattaaagcggtgattcgccgcgacagcgaacaggccagccaactggtgcagtacttgtcgaccttttttcgcaaaaatttaaaacgcccgtcggaaatcgtcacgctggcggatgaaattgaacacgtgaacgcttacctgcaaattgaaaaagcgcgttttcagtcgcgtctgcaggtacagcttgatgttccatcgacgctttcacgtcagaaattgcctgcgtttacattacagccgattgttgagaacgccattaaacatggcacgtcgcaactgcttgataccggcaacgtcgctattcgcgcccggcgcgaagggcagcatttgatgttagatattgaagataatgcgggactgtatcagccttccgccggcagtagcgggctggggatgagtctggtggataaacgtctgcgcgaacactttggcgatgattatggtattagcgtggcctgcgagccggactgttttacccgaattacattacgacttccactggaggaggacgcatgattaaagtgctgattgtggatgatgagccgttagcgcgggaaaatctgcggattttgctccaggggcaggatgacattgagattgtgggagagtgcgcgaacgcggtagaagcgattggcgcggtacataagttgcgacctgatgtgctgtttctggatattcagatgccgcgtatcagtggactggagatagtaggaatgcttgatccggaacaccgcccgtatatcgtttttttaaccgcgtttgacgaatacgccatcaaagcctttgaagaacacgcttttgattatctgctcaagccgatagaggagaaacggctggaaaaaacgttacatcgtctgcgtcaggagcgcagtaaacaggatgtttcgttgttgccggaaaactcgcaggcgcttaaattcattccctgtaccggacacagccggatctatttgttgcaaatggatgatgtcgcctttgtcagtagccgtatgagcggcgtttatgtgaccagcagtgaagggaaagaggggtttaccgagctgacgctgcgcacgctggaaagccggacgccgctactgcgttgtcatcgtcagtttctggtgaatatggcccatttgcaggaaattcggctggaggataatgggcaggcagagctgattttacgcaacggcctgacggtgccggtaagccgtcgctatctgaaaagtttaaaagaggcgattggcctgtaaaagactgttagaatatcgttttgccatagaaacgaccgaaggcctcatgctgagtaacgatattctgcgtagcgtgcgctacattttaaaagctaataataccgatctggtgcgtatcctggcgctgggtaacgttgatgctacgccggagcagatagcaatctggttgcgcaaagaagaggaagaggggtttcagcgttgcccggatatcgtgttgtcctcatttctcaatggcctcatttatgaaaaacgcggcaaagatgaggcggcgcctgcattgacggcggaacgtcgtatcaacaacaatattgtgctgaaaaagctgcgtattgccttttcgctaaaaacagatgatatcctggcgatacttaccggtcagttgtttcgtgtctcaatgccagagatcaccgcgatgatgcgcgcgccggaccataagaacttccgcgaatgcggcgatcagtttatgcgttattttctgcgcggtctggcggcccgtgaacacgcggcgaagtaattctgcggtattgttcccggcagcgtcctgtctgaccgggaaaacgcattattatactaattgattctatgatacccgctctcttccaacagtttctgcgagcgaatcattgacagatagtacgcggaacagttgtcaattgatgatcctggcaatttacagaggtcgcttatttttgcctgggtaaaatcaatatccacatattccgtagcatagctatcataatagtcgattcgttcagtcaaacccggcataccctgataagcttcgccgacttgactcagcattttttgtgcttcttctttattattggctttcagggtcttataaagtagtttatgttcagatatttgacgtaaaacgatatcccctttgtagtaataggttaacttgatttcaataccgttgagattacctacatagcgttgtgtttcctctgactctttgctagcggctatcttcttgataaacgctgtcatgttattttgctttccctggagagtatcgtttttctgatcgcagccagttatgctaaccgatagagagagcgcgaatagtggcagtgccataagacgtagaacctgcataacaattccttgtcgttaagtattggtgtggccaggaattcagggattataggctttggcgaggggacttacagcgaggctgtcttttttcggaattcataaagaaaagacgctgccgaagcagcgccctgagcgactttaccagtcgatgcaatacattatgcctgccagttatttcgcttctttaaaaccagcagcttccagcagcgtctgggtttgtttcatgctgatacctttgctggtatcgccggacaccatcgtccctgagatttgctgtaacgctttaaagtccactttttccatatccacagagacgttttcctgggcataggtatcttcataggttaatttttcttccactccggcgatatttttatatttcgcgctcagcggatcgagaattttggcggcatcttctttcgttttagcgcctacagtggcatagctgattttactttcagacgtctgcttaatgattttgtcacctttataggtgtaagtaattgaaatttctgtccccgccaggtttgcgttaaaggtctttgattcttctttatcgccacagccagcaagagagaacaccagtacggaagccaaagccgcggacaataacttgccagaaattttcatctaaaactccattttatataatgattgggtttttaaaataatttcaatgaattaatttaacccagtaatagcaatgtatcagggagagatagaatatgacttttagccgttatttagcagtccggatatggagtcttaacgctattgcttattaaggaaaaagttaaaacacgcggatggggtgatatgccagtcaggattaagcggttaaaaaagccggagcatgctccggcttgttgcttatttcacctgttggccaggcttcgcgccgtcattagggcttaacaggaagatatctttcccgccaggtcctgcggccatcaccattccctcggagacgccaaagcgcattttgcgcggcgcgaggttggcgaccattaccgtctggcggccgatcagcgcctgcgggtccgggtaggcggaacgaatgccggagaagacgttacgcttctcgccgcccagatccagcgtcagacgcagcaatttgtcagaaccatctacgaactcagcgttttcaatcaatgctacgcgcaggtcaattttggcgaaatcgtcaaaggtgatggtttcctgaatcgggaagtcggctaacgggccggtaaccggcgcggctgcggctttcacctcttctttagacgcttcaaccagcgcttcaacttgcttcatgtcgatgcgattgtagagcgccttaaaggtgttgaccttgtgactgagcagcggctgttcgatggcatcccagttcagttcgctgttcaggaaggcttcaacgcgttcagaaagcgtcggcagtaccggtttcagatacgtcatcagcacgcggaacaggttgatgcccatcgagcaaatggcctgcaggtcagcgtcgcggccttcctgtttagccaccacccacggcgcttgctcgtcaacataacggttagcgacgtcggccagcgccataatctcacggatagctttaccgaattcacggctttcccatgcttcgccaatcaccgcagcggcgtcagtaaaggttttgtacaattgcggatcggccagttcagccgccagcacgccgtcgaaacgcttattgataaaaccggcgttacgggatgccaggttgactactttattgacgatatcggcattgacgcgctggacaaagtcttccaggttcaggtcgatgtcatcaatgcgtgaagaaagcttcgcggtgtagtagtagcgcaggctgtcggcgtcaaagtgtttcagccaggtgctggccttaataaaggtgccgcgagacttagacatcttcgcgccgttcaccgtcacgtaaccgtgaacgaacaggttggtcggcttacggaagtggctgccttccagcatggcaggccagaacaggctgtggaaatagacgatgtctttgccgataaagtgatacagctcggcgtcggagtcttttttccagtactcatcaaaactggtcgtgtcaccgcgcttatcgcacagatttttgaaggagcccatatagccaatcggcgcgtccagccagacgtagaaatatttgcccggcgcgttcgggatttcgaaaccaaaatacggcgcgtcgcgggaaatgtcccactgctggaggccggattcaaaccactcctgcattttgttcgccacctgctcctgcagcgcgccgctgcgggtccacgcctgcaacatttcgctgaatgacggcaggtcaaagaaaaagtgctcggagtcacgcattaccggcgtcgcgccggacaccacggatttcggctcgataagttcggtcgggctgtaagttgcgccgcagacttcacagttatcgccgtactggtccgcggatttacatttcgggcaggtgcctttcacaaatcgatccggcaggaacatgcctttttccggatcgtagagttgagagatggtgcggttcttaataaaaccgttctctttcaggcgcgtataaatcagctcggacagctcgcgattctcgtcgctgtgcgttgagtggtagttgtcgtagctaatattaaaaccggcgaaatcggtctggtgctcctggctcatttcaccgatcatttgctccggtgtaataccaagctgctgcgctttcagcatgatcggcgtgccatgagcgtcatcggcacagatgaagttaacctcatggccgcgcattcgctggtaacggacccagacatcagcctggatgtgctccagcatatggccgaggtggatagagccgttggcgtacggcagcgcgcacgttaccagaattttcttcgcgacttgagtcatagtgggtattacttcttctgttgtaaaaaagggctttgatagtaccaaaatggtaattactgcgccaatcgataagggcatttatccgtaaatgaataattgttaccgctggagtaaactacaaagttacaatcgtacttttcagaactacaaaaggagtcgggatgaacgaacaatcccaggccaaatcaccagataccctgcgagcgatggtcgccgggacgctggcgaattttcagcacccaaccctgaagcataacctcaccacgcttaaggcgttgcaccacgtcgcctggatggatgatacgctgcacgttgagctggtcatgccgttcgtctggaacagcgcgtttgaggtattaaaagagcaatgcagcgccgatctgttacgtattacgggcgcaaaagcgatcgactggaaactgtcgtacaacattgcgacgctgaaacgcgtcaaaaatcagcctggcattaatggcgtgaaaaacatcattgccgtgagctccggtaaaggcggggtgggtaaatcgtccacggcggtaaacctggcgctggcgttagaggctgaaggcgcaaaggtcggggttctcgatgccgatatttacggtccgtcgatcccaaccatgcttggcgcagaagatcagcgcccgacatcgccagacggtacgcatatggcgccgattatgtctcacggcctggcgaccaactcgatcggctatctggtgactgacgataacgcgatggtatggcgcggcccaatggccagtaaggcgctgatgcagatgttgcaggagacgctgtggccggatctggattatctggtactggatatgccgccgggaaccggggatattcagctaacgctggcgcagaacattcctgttaccggcgcggtggtggtgactacgccgcaggatatcgcgctaatcgacgccaaaaaaggtatcgtgatgttcgagaaggtggaagtgccggtgctcggcattgtggaaaatatgagtatgcatatttgtagcaactgcggccatcacgaaccgatcttcggcacgggcggcgcgcagaagctggcggaaaaataccatactcagcttctgggtcagatgccgctgcatattagtctgcgtgaagatctcgatcgcggtacgccgacggtggttagccgtccggagagcgagtttaccgcgatctatcgcgaactggccgatcgcgttgcggcacagctttactggcagggtgaagtgattccgggagaaatcgccttccgcgcggtgtaatcctcctgacgtattccaaagagaatatgacattcactgcattaatatatattgatgcagtgaatgtattaataaaataatagcccccgcattgttaattcctgcttaaacagacaggtgtttatctgaaataatcggcaaaaacattatttgaattgatcatacctatcctactgatttattttttcaattggttttaaggtatcgatacgttcatactgctcatcaggacggcctgcatactgtttgacgttcaccagaggaacaattactcactatgaaaaaatatttgctgatgggaattatagtttcggcttatgggataagcgtacctgtttttgcctccgacaccgcaacattaaccatcagtggaaaagtgaccgcgccaacgtgcagtacagaagtggtaaacgcacagttgcagcagcgttgcggcaacactatccacgtttcaactctgcaaacacccgccgctacgccgatgagaggtgtgacaacgcagctatacacggtgcctggtgatagcacccgacagattgttgttaatcattacgactaattcttattaattccgcaggcccatatcattgatatcaatgatatgggcttttttatttgttgtgtttatgtttaagggcagtaaatttcggaaattaataagtttacaaaataatgataagcaatgattatttgttgcaattatattgcaatctgtaaattgttttaaatcaacaaaacatcgtgtttacattgcgataacttcctgtctatgagaattttcgttgcaagggttaataactcttaacaaatagaaattacttcattaaggaagagattatgaaacgttcacttattgctgcttctgtattgtctgctgtatttatgagcgctggggcttttgctgttgatgagtatgattcaggcgttctgaatattaacggaaaggtggttggtactacctgtcaatttttgggtacgaacaccgctgaaattagactgaatgaaattggtgcggataaaataattaatttaaccccgggtcagatttatgacgcagtaactaatcaaactcagatgccgttgaaaataaaatgtcaacagggtgtagcgccgcgtattaccttctcttcaacgcaatttgacagccacgatatcacatttaataacgggtctgccaaaggtgtcggttttgcggtttactacggaagtacggataatcagattgatccagagacgggggtgacactagatccaaatagcagcggtgaatacgacctgacttttttagcacgctatgcgcgtttagacggtgatgttgcttctggtgatgttagctcaacactgactttaacggttgttactgactaatttattcaaccggcggcgttcgtcgccggttttttataagcaaggccgtgtaaatatgaaaatattatctgcagtattattatctgccataattttgcctgcgcatgctggtattgttatttatggtacgcgtgtgatttacccggcagagaagaaagaagtcgttgtacaattggtgaatcagggcgagcaagcttcgctggtacagtcctggattgatgacggtaacacttcattaccgccagaaaaaattcaggtgccatttatgctgacgccgccagtggcgcgcgttgccgctgagtctggtcagcagatcaaaatcaagaaaatgcctaatagcttaccggacaacaaagaaagtctgttttatctgaatgtgcttgatattccaccaaacagccaagaaaacgccggtaaaaatgtgcttaaattcgcaatgcagaatcgaataaaattaatatggcgccccagtcgaattgccgccgtaaccaaagacagttttcagaggattggtttatttcgcagtaataaaactgtcatcatgaaaaatgatactgcaaactggattaccgtgacggatgtaaaagcaggaaatactaagattaatgatcaaactatcatgctgccaccgctatcgacgcaaaatattaacatgaaatatgcgtcaacaagccagtatgaagtaacgattattgatgataatggtaactatattagtagcaaaattaatgtaaaataaacaggagttcatcatgctaaggatgacgcccatcgcttcgcttgttttattgactctgtttacctggcaaacgcaggctatcgcgacggaaacgtttgatactcattttatggtgggggaatgagagatcaaaaaataacaaatttccatctggatgagaataagccaattccgggacagtacgaattggatatttatgtcaacaatcaatggcgaggtaaatacgatatcattgttgccgatgatcccggtagcacgtgtatttcaactgagttgttgaaaaatattggtgtgataagcgatggtctgcaaccgcagggagcaacggattgtattgcgttaaaagatgtcgtgagaagcggtggctatacttttaatattggcgtttttcggctggatttgagcgttccccaggcctatgtaaatgaggtcgaggcgggttatgtattgcctgaaaactgggatcgcggcatcaatgcattttatacttcttactatgccagccagtattacagtgactataagaattctggcagtagtgaaagtacttacgttcggttcaatagcggtttcaatctgttgggctggcaagcgcatgcggataccacatttaataaaaccgatggcagcagcggtgagtggaaaagcaacacattgtatctggagcgcggtatcgctgagctcctcggcacattacgcgccggggatcagtatacctcgtcagagatttttgattctgtgagatttaccggcgttcgcctgttccgcgatatgcaaatgttgccaaactcgaaacagaattttacgccgttggtgcaggggattgcacagactaacgctttggtaaccatcgaacagaacggattcgttgtttatcagaaagaggttcctcctggccccttttccattgcggatctgcaactcgcgggcggtggcgcggatcttgatgtcaccgtgcgtgaggcggatggttcgataaatacctggctggtgccttacgcttccgtaccgaacatgttgcagcctggcgtctctaagtatgatttttccgccggccgtagtcatattgaaggcgccgataatcaggccgattttacacaaatcagttatcagtatggccttaataacctgttgacgctttatggcggtacgatgctatcgaaccattataatgcgtttaccctcggcacggggtggaatacccggattggcgccatttcgcttgacgctacgcgagcgcacagtaaacaggataatggcgatgtatttgatggtcagagttatcagattgcttataataaatacctgacccaaacattaactcggtttggtctggctgcgtatcggtattcatcacaggattaccgcacatttaacgatcatgtctgggccaataataaaaataactatcgtcgcgataagaatgatgtatacgatattgctgattattatcaaaacgattttgggcgtaaaaatacgttttcagctaatgtgagccaatccttgccagaaggatggggcgcagtatcactgagtgcattatggcgtgattactggggacgtagcggcaccagtaaagattatcaaataagctattccaatacgttccagaaaattaattatacgttatccgccagtcagacttacgacgaggatcataatgaagataaacgttttaacctgtttatttcaattccctttgactggggggacggtattactaccccgcggcgtcatctgaatgtgtcgaactcgacgacctttgatgatgatggatttacctcaaacaatattggtttaaccggtacggcaggcagtcgcgatcaatttaattacggcgtgaatgttagtcatcagcgacacgatagtgagaccacagcggggacgaatttaacctggaatacgcccgttgcaacgcttaatggtagttacagccagtcgtccaattatactcagaccggcggaagtatttccggtggggttgtagcctggagtggcgggttgaatttatccagccggctttcagatacctttgcgattatgcaggctccgggacttgaaggagcctacgttaacggccaaaaatatcggaccaccaataaaaaaggaacggtggtttatgacaaccttacgccatatcgcgaaaaccatcttatgcttgatgtgtcgcaaagtagcagtgaaacggaattacgcggtaaccgtaaagttgccgccccgtaccgaggggccgtcgtgctagtgaattttgataccgaccagcgtaaaccatggtttattaaagcgcagcgtcctgatggctcgcctcttatttttggttatgatgtagtagatcatcatggtcataatgtgggcattgttggacaaggtagtcagctatttattcgaacgaatgatattccgcccgaagtcagtgtaccagtagataaagagcaggggctttcatgttcaatcacctttggaaaaacggttgatgaaagtaaagtttatatttgtcggtagtggtgaggtggtgaaatgaaactctttctttttatcgtgatgttattgattttacctgaaacatacgcagcctgtacgggagaaattacttatcaggataatttaattattcgtgaggattttacgattaaccctaatcagtccgcaacttatagccataattttaacgatacaacttgttcagggacttataagataacgcgtatggatccttccgatatcatcgtgggattatacaatgatacagtaaaactgaagttaaaaatcgcctgggcagataataatactctcacaatgccgtttacaacgggctatacggtaacggttgaacccgcttcctctggggcgaatgtaaatatttctgccggtagtgggaacagtgtcctaatcaacggggtggtatcaataacaagcgcttcttctgcaactcagtttacggccagtttgcggtttttagggtgcctgctagcaggaagaggctggaatgcctgtgccgcagattataatagttatcttagaggtgcagggttatattcatttgatctgtttgtgtcctacgatcgcaagcagacaacctgcaaacctgaagatctgacgatcacgctaccgaatattgcgctttctgaattatataacacaggcaaggtcagcaacaaaaatgccgcggataatattcgactccagtgtgataatctttttggtaatgctaaacaaacatcgcgtaaaatgacggtttatctctccagcagtgatttaataccagatagctattctgtgttgcgtggtgctgtgaataatggcgtcggatttatactggagagcggtggaaaaacggtgaatatttcaaatacagcagagcagggtaatgcttcaacgttatggaaagtggatcaagtaggcacgccgctcaacagtgatatgataacaatccctattatcgccagttattatgtttatgaccgagacaatataaagccaggcgatctaaaagcgactgcgctgatctatgtgaaatacgattaatatatatgaaaaacatttaagatatatggcgcgataggtgaatgaacttccggtcacttacaataataagtgaccgggatgacaatctttctgcaataaattctaatgtggtatgcggtagtttcaaaagggcgagatccagagcgaatcgggtagtgaaggcagtcaacaaaaaggaggtttgaaggggatagagtgattaagggctaataaaaaagtaacatggggctgtatttccccctctggatgagggggctttttttatcgatgataaaaaatctcgccatcataggctttgatgatttttccatcggtatcgttaatcagtacatacgcgccgcccatataggtccagtgagtaccggcatctggcgcgggcagattacgtaatttccactgtttaatattatactcatcggtgcggtacatttgcggaacggtatcgccgggcttgaagtgggtgaagtcggcgataaagctttttaactcatattgatcaatgcccgttgtcgcgggggcggcccatgcaaaactggttgcaagcaacagcgcgcaaggcagcaacttacttttcatacttttaccctccacatatgcgggtcagttaacatcgtgtgtatcatttctgctggtggcgtatctgacaagcgctattttgttatctcacgccccttttcgtaaaaagtgtaaacgaaagcgtcgtgcagcaacatatccgccagcaagtttgccagaaccgaataggttttgagaactatctgataacgctaaaattatcgtccgccgctgactgtaaatttacattgtctggcacagacagtatgcttaatagcgaaaccccgcttaacacggtggggcttgacgactcggggtgcccttctttgtgaaggctgagaaatacccgtaccacctgatctggataatgccagcgtagggaagtctgacactgctcgtgtcccttcttcacgcgggcaggagctgaaccatgcagcctgacctgcactgccgcacgcttgcggcgcatacgttaaaacactttcgcgcgctctccccgcttacgcactgtatgacgaatgacgtcgtacaaacgtttaccgccaatacgttgctggcgctgggcgcttcacccgccatggtgattgatcctgtcgaggccagaccgtttgccgccatcgccaacgccttgctgattaatgtcggaacattaactgcctcacgcgctgacgcgatgcgtgcggcggtagaaagcgcttatgatgccaaaacgccgtggacgcttgatcctgtcgcggtgggcgcgctggaatttcgtcggcgattttgcctggatctcttgtccctgcgcccggcggcaatacgcggcaacgcctcggaaatcctggcgttatccggcatggcgctgggcggacgcggcgtagataccaccgaggcggcgttggccgcactgcctgcggcgcaggcgctggcgcgtcagatagactgcatcgttgtggttaccggagagatagattacgtcactaatggtcagcgcacgctgagcattcccggcggcgatccgttaatgactcgcattgtaggcaccggctgcgcgttgtcggcggttgtcgccgccagttgcgcgttaccgggcgccgcgctggacaatgtcgcgtcggcctgctgctggatgaaactggctggacaggtcgcggcagagcgtagcgaaggaccgggcagcttcatcccggcttttcttgatgcgctctatcatctggatatggaggcggccaatgcaacgaattaacgcgctgacgattgccggcaccgatcccagcggcggggccggtatccaggcggatctcaagaccttttccgcgctgggcgcatatggctgttcggtcatcaccgcgctggtggcgcaaaatacctgtggcgtacagtcggtgtaccggatagagccggactttgtcgccgctcaacttgattccgtgttcagcgatgtgcgcattgataccacaaaaatcgggatgctggcggaaaccgatattgtcgaggccgtggcggagcgactacagcgtcatcatgtacgtaatgtggtgctggatacggtgatgctggcgaaaagcggcgatccgctgctctcgccctctgcgatagaaacattacgcgtccggctgttgccacaggtatcgctgattacgcctaatttgccggaagccgcagcgttgctggatgcgccccatgcacgtacggaacaggagatgctggcgcaggggcgggcgttactggcgatggggtgtgaagcggtattgatgaaaggcgggcatttagaggatgcgcaaagcccggactggctctttacccgtgagggcgagcaacgttttagcgcgccgcgtgtgaacaccaaaaatacgcatgggacgggctgtacgctgtcggcggcgctggcggcgttacggccccggcatcgctgttggggagagacggtaaacgaggcgaaggcatggctttcggcggcgctggcgcaggcggacacgctggaagtggggaagggcattggtccggtacatcatttccacgcgtggtggtagtatactgcctacagacccgtcgtcaggaaagataaatggaacaagcgcatacccggctcatcgcgcaactgaatgaacgaatttcagcggcggataatacgccgctatacatgaaattcgcccagacggtaaaggatgccgtgcgcagcggtattcttgagcacggtaatattttgcctggcgaacgcgatctcagccagcttaccggcgtctcgcgcatcacggtacgaaaagcgatgcaggcgctggaagaagagggggtcgtcacgcgcgcccgcggctacggtacgcaaatcaataatatctttgaatattccctgaaagaggcgcggggattttctcagcaggttgtcttgcgcggcaaaaaaccggatacgctatgggttaacaaacgcgtggtaagttgtccggatgaggtcgcgcagcatctggcgatccccgcaggcagcgacgtctttttactcaaacgcattcgttatgttgatgaggacgcggtatcgattgaagagtcctgggtgcccgcgcatctgattcatgatgtcgacgcgattggcatttcgctgtatgactattttcgtcgccagcacatttaccctcagcgtacccgatcccgcgtcagcgcccggatgccggatgatgagtttcagtcgcatattcaaatggatggtaaagtgccggtgctggtgattaagcaggtggcgctcgatcagcagcagcggcctattgaatacagcatcagttattgtcgtagcgacctatacgtttttgtgtgcgaggagtagcgcctcgcgcgtgggcgcgcagtcgccgccgcgatgcccgaccacccagctcgccaccgcatttcccagcagtacggcatccgcgagcgaccagcctgacgccagtcctgccagcacgccgccagcatggctgtcgcctgcgccgatggtatccaccacggttgccggaaacgctggcacaacgccggaagattgcgcgctaaaataccacgctccgtctttatcgtggcgcaccaccagcggcgcggaaaagcgttttacccatgcttcgccgaaagtgcgggtatcggtcgcaagcccggcgcgttccgcggcgatgatggcttcctggcgattgagggatacgatgggccggcaggccataatgcgcgccattgcatcgtctgtaatatcaccgattcgcgggccaaaatcgataaaaggcgttacatcgtcgacggtttccagccactggatcagtggctcgccacaggacgaggccagttgatagccggacaggtagacaagactgccccgcggtgtcctgagctgcgacagccagtccgcattccactggttttccacgccgctaaaagacataaacgtgcgttcgccatccggttcgactaacgccagacaccagccgttatctccttcaaccgcgtcaatcacgctggataatccctcttttgccagacggcggcgaatcctctccgcccacacgccctggcccagcggcagcgcattgctggcgtcaatccccagtcgtttcaacgccacggcaatattcagcgcacagccgccgacattgacgctctgttgttgcagttcaatatcgcctccgcgacgcggcaacgtccaggcgtcggcaatgatatcgatcactgccgcgccgataacggtgagcggacgccgggtatgcagggtcggtaataatgtcagcaaccgtgcgccgttcatagtgcctcccgccgttgacgatagctcgccagcgcaacggcatagcgcgcaaaatccagctgattaaccttgtccagcgtttgctttaactgggggttaatggcgcttaccccgtgcaacgcgccgcaaatggcggtagccatcgcgccgatagtgtcggtatcgccgccgaggttagcgcacagcacggcacagcggttaggatcggtattcgccagctccaccatggcgatagcgcagggaaccgattcaatggtgctggttcccgcgccgatgatctgatagagctgttcgctggcagattcgacgccgtcggcgtggcggacaatgtttagcgccagttccagacgtgccgatagcgaggcgctaaacgtggtaatacgcgctgtctgcgcctgatgggcgatggcggggagcgagtcggcaatactttgccacgtgtcgccgttaaccgctcgcgagacggcccaggcgacaaccacggcgccagccaccgccagatcggatttatgcgtcgggctggaggctaacgctacttctgctataaaggctgtcaggttagttggcggcaacaggcagcccaacggcgaaacgcgcatggccgcgccgttagtcacgccgttattttccagcgccgcgatgggtttgccgtcgcgaatcgcattcagcgcaatttttgacgtcgggccgagtacatttttattgaacgcatcaaagcgttccgcccaggcgaggatgttacgcccaataatctcgggatcaatgttgccttcgcattcgagtagcgcgtcggccaggcagagcgccattgcggtatcgtccgtaaactccgcgcggttaaaatagcaggcggcattattttcttttgggccgggcagaaagcggtcaatccagccgaaatgcgctttgacgcgcgttctcggccacagctcagagggcattcccatcgcatcccctaacgcttgcccgtaaagagcaccgagaatacgttctgctttcattttacttccccttgtgtcaacgcaatatcgcgatcgtcaatagcagtgatctctttgtccgattcgcgaaagaaaatcataaacagtagcgcgatgacggcaatcatcactgcgccaaacgtccacatgcccgcccagttgaatgtcagaccgttaaccggttgcggataagcaaacatttttttcatcatcacgccgccgagacgatagcccagcaggctgccgaatccctgacagcagagggtgataagcccttgcgcagcggtacgcatatgaaccggcgcttttttatcgacataaatgtaggcggtgacgtagtagaaatcgtaacttacgccgtgcagcaaaataccgaggaacagcagggcgtaagtgaagtacgtctccgcgccgccatagacaaaaaagccgtagcggatcgcggcggtaataagaccaagtaataatacctttttaataccaaagcgcttagtgaaaaagggtagcgccagcataaagaagatttcagagaactggccgagcgtcatccagccggtggcgtttttcattcccacttctgtcagatagccgttagcgaagatgtagtagaaggccagcggcatcgcaaacaggaaggaacagaagaagaaaacgagaaagtttttatcgcgcagcagaaccagcgcatccagccccagcatcactttaatatccatcttgccggtgctttttggcggcgtgtctggcagacagaacgcaaatacgcccagcaacgctgaacttgcggcggttatgagcagtggaatgttggtgggggaaatatcgttatagcctaacatttgcggcaagaatccacaggcgaggccggaggcaatccacccaatggttcccataacgcgaatgcgtggaaaatcgcgttcaacgtccggtacgttagcgaaggcaatgctgtttgtcagcgcgatggtcggcatataggtcaatgaataggccaggagcagcggaaagaatccggcaaaggtggtttgctgtgccgcgaaatacatcagtacggcacccgcaaacatcagtaccgccaggactttttgcgctgagaaaaaacggtcggtaacggagccgaccagaatcggcgacaggatcgccgcaatggcggtacaggcataagaccagcctatttcaccggcggaaaacccgcttttatttagccatagccacagggggacgaaccaggcgccccagataaaccactccacgaacatcatgaacgacagtttaaaggtcgttttcatttttgaatccttcatgacaggtaaggtacgccacgacaataccacttaataataccttttaaataccattgagcattaattttgaccgatctaacactttttcggacgtgaatcgagtcagcagatagcgccgaaaaaatgcgctaaagttggcaaaaatggtcggtcagtaccaggcttattgcgacccgcaatctgcggggcaggactattcaccttccgataccctatcggaacttacgggagcatagctatgactgatattgcgcagttgcttggcaaagacgccgacagccttttacagcatcgttgtatgaccattccttccgatcagctttatctacccggcaaggattacgttgaccgggtgatgattgacaataatcgtccaccagccgttctgcgtaatatgcagacgctctataatactggacgcctggcgggaacaggatacctttcgatactgcccgtcgatcagggagtggagcactccgccggcgcttcttttgcggccaacccgcgctactttgacccaaaaaatattgttgaattggcgattgaggccggctgtaactgcgtggcctctacctacggcgtactggcctcggtttcacggcgctatgcgcaccgtattccgtttttggtcaaactgaatcacaacgaaacattgagctatccgacagagtacgatcagaccctgtacgccagcgttgagcaggcgttcaatatgggcgccgtggcggtaggcgcgacgatctatttcggttcggaacagtcccgtcgccagattgaagagatctccgccgcttttgagcgtgcgcatgagctgggtatggtgaccgtattgtgggcttacctgcgtaattcttcctttaaaaaagacggcgtcgattaccatgtatccgctgacctgacggggcaagccaaccatctggccgctacgattggtgcggatattgtgaaacagaaaatggccgagaataatggcggttataaagcggtcaacttcggctataccgacgatcgcgtgtacagcaaactgaccagcgataacccgattgatttggttcgttaccagttggcgaactgctatatgggacgcgccgggcttatcaactccggcggcgcggacggcggtgacactgatctcggcgacgcggttcgtaccgcggtgatcaacaaacgagccggtggaatgggactaattctgggacgtaaagcctttaagaaatcgatggctgatggcgtgaagttgattaatgccgtacaggatgtctatctggatagcaaagtcaccatcgcctgagttcaacgaagaaaagccggatgtgagcgcatccggccagcgactggtgttattaacgtagcaacgggcagtctggcggcagccgacagcgtaatgcgccaggcagcacctcaatatgaaattcttgcccgctgagtggttcgccatccagattgaacgtgatttcatgcggtgcatgaatatcaaaccacgctgaggcgccgtcaataatattcggattgtcatctgactgcgtgagtgtggaaaacagcgccggcagcagttcttcgccggtaaaaatccgtagctgtaacagtccgtcgttaatcagcgcggtgggacataattgctgcccgccgccggcctgacgaccgttgccgatgccgatcaccagcgcatctccctgccagtgaaagttttcgccacgtatttcgcagcggtcaggggtcagcgtatccattctcatcagaccgtgaataagataggagacgccgcccaacgcggctttaagtttttccggcgtttcggtggtaatgcgggtgccaaaaccgcccgtcgccatattgataaaacaggttttatcattgaccctggccatatcaatttccatcgcgtttccggcaatcgccagtttcagcgctttgtccagcgcttcaggaataccggcgctggtggcaaaatcgttggcggtgccgagcggcaaaaggcccagtgcgggggctacgccgtcgcggatctggatgagcgcggtagacacttcattaatggtaccgtctccgccgccggcaatcaccgtttcaacgcccagtctacgggcttcatcaacgtaacgctgcgcgtcgcctttttcccaggttacccgaacgtgaatctgtatgccttcgtcgcgaagtagcgtaatggcctcacgtagcggctggttatcagcgcttttgccattgaggatcagtaagctggcgggaaagttagctatccgttatgccttaataggttgaacaacaatctccagaaagtgtatagcagaaatgaaaaagcgaggtcagaacaggatgaaaattgaaacgttgcgcacttattgctttaccgtttttcttcctgctgtacgcagcggtaagcgaagcatggtttaaggcaaatggcgacaagagagatgccggtatgcgcattgagtagcgcttgtgagagtgcaaggaaaccacaaggggtagccagacgctttccgatatagcgcctttaataacgaaacggaggattaacaagacgaacatacgtcagttatcagtattaatttcaaacaccacaatatcagataaaaacctgatatttattaccaaacatactttttaatagcataaaatcgaaatgttctttagactgctttggcaggaacaagacgcactattagcagtacactattcttgttatcaaataaaacctatttagatgatgacttagcgcagtgtcttatagtcgtaccgttgcctgaggtatcgcttttctcataaacataaacaggcatgtgcatgaagaggtttatatgaatgtcacttcaggcgtgaatgcgcaaacgccattgctccccccttctgaatggggtgatgacgaaaaaccggtagctgaaatcgttgagtttaacgcttacggcaataaacccagatgtttaatgtgcctgggaaccacggcattgtttacaggtgctttcagtggggtatgctcaggggctgtcgccagtgtcagtagtggtgctgcatatactaccgctctgacgattttaggcgcatcgtttggcatggggggaattggtatgatgggaatatgcgccggactataccttagcgcaaatggcgtcagaacccggccagcctggccataaatgagcaaacacagcaagtcatagggaaaagatgaattccggagatgacacggggtgttaagcgtccagaccagaggcttatgacttatatagaaacgctttagatagagtatggggtgttatgtattcaagagccgatcgcttattaagacagttttcactgaaattaaatgccgattcaattgcctttgacgaaaacagattatgctcatttattatagataaccgttaccgtatcttactaacaagcactaacagtgagtatataatgatatacggtttttgcggaagacctccggataataataatcttgcttttgaatttctcaattctaatttatggtttgcagagaataatggaccacatttgtgttatgataataactcacaatcattattactggctctaaatttctcactcaatgaaagttctgtagagaaacttgaatgtgaaattgaggtggttattagatcaatggagaatctgtatcacattttacaggataaaggaataaatctggataccgattatacgtgacggtgggaagggtgtttggtgatctggtggtaatagaggataatcaaccccagcaaaacttacatggcctgatgaagatggactgagcgtaggtgcgatggtttgagtattactttgacatgaaatcaaacctctaatccgggaaaacattattttaatccttgtaaaagcggcattaaaacgtgccataactttacacgcttaaattatcagtttttaaccttaatttaataacctggaaactttttgtgtaagtactcacaaagcagttattgatttaattcactgattttaaacgtaaacgtcagaatgctaagtcctgagtctgaccagatgcagggaggattgtgacttgctggctggccatgaataggggaggtctctaaacctaagcgcccatttgcgctttggttagtgtggtcaattttcggatgtggcgggaagtaccacttttttattgattatacgcaaaaaataagcctgcgtaagggagattacgcaggccaaggaggtggttcctggtacagctagcatttatgggttatgtttttcagcgcgttgaataatacccgcattgagcgaagcggtatgtgatcaatttctaagaatcttcccgccatgaaaaaataaccgcaattaactacttagcatgggggttacgcgttgattcgcctgagaaattacgcatcaatagtgcgtaatccagcgtaacgtcctgcgggacgggcatccagacggtatagccatcgccaggcgccaccggcatagcgtcgcctttggcgttctccatctgttccagagtgaaattgatatttccctgcggagtcatcagctccagactatcgccaacggagaatttattcttcaccgccacggccgccagttggcctttacgctcgccggtgaactcgccgacaaattgctggcgttcggaaacggagtacccgtactcgtaattctggtaatcgtcgtgcgtatggcgacgcaggaaaccttcggtatagccgcgatgagccagaccttccagcgtttccagcagcgtagggtcgaagggtttacccgcggcggcgtcgtcgatggccttacggtagacctgggcggtacgggcgcagtaataaaaggatttggtgcggccttcgattttcagcgagtggacgcccattttcgtcaggcgctccacgtgggcgatagcgcgcaaatcttttgagttcatgatataggtgccatgctcgtcttcgaacgcggtcatgtattcgcccggtctttgggcctcttctatcataaacactttatccgtcggcgcgccgataccgagcgtcggctcaacgttctgtaccggaatcggttcatgcttatgcacgatgttgccgacaacgtcttcttttccttcctgcacgttatattcccaacggcaggcattggtgcaggtgccctggttcggatcgcgtttattgatgtagccggaaagcaggcagcgaccggaataggccatgcatagcgcgccgtggacgaaaatttctatttccatatccggcacctgctggcgaatttcctcaatctcttccagcgacagctcgcgggagagaatcacgcgggtcagccccatctgctgccagaattttaccgtcgcccagtttacggcgttagcctgtaccgacaggtgaatcggcattgccgggaagtgctcgcgtaccagcataatcaaccctggatcggacatgatcagcgcatccgggcccatctcgacgacgggtttcaggtcacggataaaggttttgagcttggcgttatgcggggcgatgttcaccaccacgtagaatttttttccgagcgcgtgggcttcgttgatgccaagctgcaaattttcgtgattgaattcgttattgcgcacgcgtaaagagtaacgcggttggcccgcatagacggcatcggcaccgtaagcgaaagcgtaacgcatatttttcagcgttcccgctggcgaaaggagttctggtttaaacatcattttctcgttctgatgacaggtcagatccgcctcacctgatgaggcggctggaagagagtcctcactttaagggcgggcattgtacgcttacggacaggccgagtaaatattgcgagagtatattggcgctaatagaacaccggatgttaatggggagccaatgatgaaaatgagccgcacggccatcgcgctgagtttgctgggaatggccgcgcatcccgtttgtgccgctccgtcgtttgaagagacggcgagacaggtgattatcgcttttcagcagcgagacaacgcgaaaattaatgccctgattgataaaaaagtcgggatgtatgtgctgtaccgaattggggctgggtttgattataaatggatgaaaaaatttgatattaataaaccgatacctgactttaactacctgttggggcaggtaggttggttttcagagcatattcctgtggataaggaatttgatcaccacacggaggttgagtacgtttgtgaaaagggatgggatcacgccggtttttttgtcagctataccggttctgataatgcgctgctgacgtttagcatggtgaatggagcggatagtggggatcaggcgtcggatacccgtatagcaaacgccaggcggcttgagctgcaatcagagcgagtggtggcagtgccgaaagaatggggtgatggtttgatttttcatctgagcgagcttcatggcttgggcaaagggtggagtttaacgctgctggatttggtcacggaagattgtagtgcgtgaggcatatatgtttaatcagggtaaatggctgcttatttatatctttctgctatcaggatgttatggcaccccctcaatattcagaatttaaataaagcatttcctgaatatgaaactaattcactaaaaaataaaggtgaaatcacctcggcaacatgcattaaagaaaatacaaaaggtcatttgacttattatagcgtcagcgatcccgtctttaactaattcgggtcacgttatgtatccactatggggaatctttatatattccgaaaaaaaacacaatgatattcttaatgcagataagagagtaatcttagggtgtgcaggtttgtaaaccagggtatggcggtagcgttattttttaacgaggtatcatcagaggtagaattaacgatcgcagacgatactcagtactaagaggaaatcaggttgaggttgaacagaaaatgataaatacgtattgataagatggaatccattgaatctacttattagtagattttattatgaaaaatatatttttcttgatgttttttacgcattgcgcaatagcaaatccttgccgccttgatgcaacttgagtgattttgtgtatagtgtgacaatgctgaatactgaattgataccttctacatattaaatcagggggtagttgtatgggcgattttataaaatatctatttatttttccttgcttatggagcgcaaattcttttgcgattactcaaactcaatgggatggtaactttagagtcgaggaacttggcgagcagttaaatgataggagtcaggtttttttacaatataatttaaagatagatagtaaaaataatcgtgcttctttatccatgacaacttggcatgcggggataacatgcattggtgactactctttaaaaatcaattctggtgttttggtattatactataacggcgacgaggaaaatgcatgtccatatccatcaccgcaatttgagataagcaataaaggaaaagagtattatataaaaggaaaaatgttttcatattctcagcctggtgagtggttgccactcaaacgtattacactaaaataattctatattccataaattatgacgatgaagttaatgatggtataaaatattaaatggatatgtcgtgaacatatttttgttatatgttttcaatgtgtatgacaagaaaatttgcatgaaaacattatatgagacggtttgaaaaatgaatgaagttcacataaaagcaaggtcattctgaaacgaatttgtcaaatttgctgaattatatatcaataattactgagtatcgacaacaatgtaaaatcgagtacaaattcacggattctcttttgctgatggtttgtgcagtaattggtaggactgaaggttaggggagtatatgaagaaaacaatattgtcttttgttctgtgcttttttgtgaatttttgtcttgcagatatgcatattttaaagataaataaatcacactatatgcgctttttgccataaaaatgtgtaatagcacatcaattataaagaatagagaatatggcgggttagtctgtaaacctatagtaataaatgtattgcaactgaagctaagtagtgaagcttggttggtttttctccgtcaaatagctcttgtccttttggctcgactaaggttggtgattatcatacacatggcttttactctgatctaaaggggaatccagtattacctcaatatgaggcatatgactctttacatttttcaccgcaagatatttctgggattgcaagtgatggtataggtaatcctgattatactggctttttggggactccagataataaatattataagtttacccctggaactggaaaaaactgagggaatgaaatgaaatatattatttttgcatttatttttctaattccgttaagatgtatgagtgaaaaacttgtttttttagatgaagtacaaacaaaaactatgaatgttgctttttcacattttagagagcatacaaactggggcttatttaataccatgatacaggatgatgatgaaaatattaaaatcgcattctattgtaaatctcatctggaagaagcccgtggtggcggtatggagcaaattatttatataatttcaaaaaaagattttaaaattgaaaaaataaacaaaagttatagcaaatgaaatgatataaattgttgagtaattggtgaatattctctggtgttacccccgagcaaatggaacaagtacagcgagctattgactatggttcaacgaaaggtgtgactgtagtttttacaggagcaggaaaatgacatttatatttgatgtaaataaagagtatcacgcgggtgctaacctgacagataagtttttatgtttagaaacttattcgggattggggcgctattcttcagatcctgattacccttgtcagttattatctattgattcggatgatgtatgtatcggtcatgaattattacaagcattaaaaaatagcagaacttacaccccagaagagagtgaagagtatctttctttagagaaaacacaggtggagtatgatgagtgggtcactgtattgatggcaaaatataattatagaaccaggcgtgcattatttaaaaacatgaagtattgctcaattatatgcgtgaataatattattaagatacaacctactcgacatactaaacttgaagggtggagctgggccggacatgacaaagatgtaattagattgcctgttaccagcgaaccagagaaaattggaagtgcattgagacaggcatttgaatgttgtgattaatagcctgatgataggttatttatgtttgatagaaataagacaataaatttacaattgttgtaaggtctgattgatgttaaaaatagttatgctttttttgatgttttttccctgttattgcttacctatggatattaaaaatataaaagattgtaagttggaggaaggtaatagagttaaattaatttcattgagcactgttgatggtagtacgccatacttaatctttgacaatgttattgttagcgcatttcttgatggtagtatctattctggggacattatcctctcaaaatatatccatcactccctcatttttgcgctgaattacggcgctccttatatgaaaggctgtttgataacgggtttgagtgccagtgctgagagaagctataaacccaatggcttttgttttgcagaaagaaatattccagagtctgtctggtttggtgaagatcatacgttaattattattaaaaataataatagtgttggggaatggcgtggtaattatattatctatgatagccgtggagatgaggctcaaacatttaataaattgcctgacactaaaaattataaaatttatcgattagatttatattattgttcatgctatgttttctgggaggatcgtcaggttatgcgaattcagaaaagaacatttctaaagaacttcttagtgagtataaaaatttttcacttgctgagtgtattgaaaaaaattatgaaaaaatgggcgttgtttttactaagctacctttaaaagataatacaagaggatttatcgatttggatatggggcttgctttttatcgggataaagataatgttttagcttcatttatagaaaataaaacgggtgatttttataagcccaggcaggcttatggtgatttggcatcggtaaacatggttatatatgactgtatcgatttttatcattcaaaagaattgaatatatttttacgtaaaataatttctgaaagaaacattagaaatgagaatgattaacttaaataaaatgtttaattaagtctcaaatctattctatttcacccgaaatgaataagatatatcagatgtataaaaagatagtaatattagtgattacgcttattattatatttttcggcggtgggtggtatatgcataaatcacaacaacaaatggcaacccttgttatttctgatagtgaaaatgccctcgattatccgaataaacgtaaatggtttgatgccagtagatggctcagcacatcacaatatattaaaatagatgatttttatcttttaaatcttaagcatcatccagttaacaatataaatgatgcagggattattgtaatattacactttgcaattcgggatgcgataaagaaatttccagagttatcaaaattaagccagatggataataaggaattttttcatttcatgcagaataaactttctaacgagtatcttagaaccaaattcaatgaagatacactggaacctactgatgactattttttgttcttttttacttataatgaaatatcttatgaggtggaattattacggaaagttactgagcatggtatgatgtttgtgccttatggatatcaagttaataaaaaaggggattggcacagaatgcatccatctacatattcttgttttaacgatatccaaagtaattagtgagacgttacgaaagctttttaacaccatggatgatgagtcgtttaatgtcgcttttgcagcatgtagaagaggagttaataatcctgtctgatatcggaggggttaattgaagtatatgaagcatttttttctaatcctttttgggatttcttctccatttatatgtttggctacttctgttgaatttaatgttacaaagggaataaaagcatcaatcacttgggtggataataaaaaagttgagtatgaaattacaggtagtgatcgtgtggcaaagagaggatattatgatgttgatacggaaaataatatccatgttaaatatggtgattataattttgatggtaaagaagattttgtgatttggtatacagatgatggtatgggaatttatgatatatatagggtttttctctattctgagaaaatggctgactttaaagaaataaagccatcatgtggcgatgattttataaatttaaatctgaataagaagaaaagagagcttattagtctgtattattctcataatgaggcgcaaagatgtattactaatgtttttgttggcgagaataaattaaagtgacaagtggtggtcttttatttcaggagatgattaattgataattattttattctttttgggatgattattggttagttctacttatggtgaagaaaattataaaaatattcattttaaaaacgcaacgataaatattcctgccagatgggtagctaataaaaaagatgattgtttattgattagtaaaaatcatataaatgtgttcagttatctttatgtatgcacagatgcggcaacgaataaaaattctttttttacaaagaatgatgatggagaatgggaggccgttactgatggcgtccctgttttagctgatgtaaatattacgccaaaatttattggcatgagtgcaatcgtttcatgtaggtacaaagatgatgctgggtatcatatagaccagtgctttcaggcagtgatagtattgtcaacaaacataatgtttgtttttattggtagaggcgattcatccttatttaataattataaggaaatatatcgctcattcaaggttaaatagcatgtgattaattgatggggattgggtgaatgtttttcattaattacgactgtgtgatgcttcataatgagcagactggatatggaattaatcaatcgatgagaatatactttagatgaagtggataattatggttttagttttttctttttctaatgtttatgctgaagactgttcacaacaagactttgataaagcggatatggcgttagactctcttgcgtcatggaaagctgtcgatggcttttattcccgacatagtcaatgtgatgtgggctacctccgggaaggcacgtcagaaaaaattatcagattgttagtggatagatggggagaattgaatgagttatctgcgcttatcaaaaggaaaccagcacttggcgattatgttattgatcatattggagagatactcgatgtaaaagatgttgaaaaaataagggattattcagcatctcattgccaaattgatagtaaagatctatgtaaaaaactgcacgatgcagctgtttatattttaccgtacatgtcttctcagtatcaatatcttaataattgacgcttatttagcaatcatatcatgagtttttaattgaaaaatacaacaatgcatgatgacaatattttattatatagctttcaatatataacccaatattaatgccgattatgaataattatagattaactttttctttatgtttactgcgttcggccatattgtttggcattattttaataagtgttaattgtaataatcaaaagagtaaggaattggttcttcctgttgattccacgcagtttacacaattggcttgttattataaagatattaattccgatgataatataatggagttaaaattaccagatgaatataaagagaaaactaacttatttaatcaacaggaaattaaggtgccggtaaaaggtgagagttttctttctccgtatattggtgatggtgtccgttattatgaattagggtactttgaacatgatggtaatacttacaaattgataatttataataaaattggagagtctgatacgttattgcttaatgtacaaataaatagttatgatgcaaaaggaaacctggtggatgctttattgcttagtagcttttttgcttatgaagacatcgtgcgtttttctgattttgtcatccgccaggattacacaataagcattgatagttatgttatatacaggtggtatgaggacagcaaagatggtcatcttgtaactataaagtttaaagatcaggcgcctcagatttatataaaggaacaatatcaaatggaaaatggtcgattcaaattgatatccagaaatgcagtatcacagggtgaaaaaagaagcgagcgttaaatataccatgcttacgacattaataattgtaatggaggtgttaagataatatggatagcaggaaagaatgaggaacgttatggaaattataaatagattgttaatttcaactgatctcaggttaatcataaaatttcagtttccgcgccagatttattcaacgcgcagatagtgcccgtcggcgcggacatttgcgccaaaaccgcagtccacaaacgtatcagtgctggcatcaatggtttcagaagaaaaagccagcgaaatgtcacagtgaatatcatcgccttcccgaagcgccacgatggctttatcgttttccagcgttatctctgcgtagaactcgccgatattggggccgaagtagatccccattaaaccgaaccagtaaccctgaaaattaacctgatagcgcgatggggtgggtaatgccttcacgctaagcacgttccaggaggcgcgcccggcatagcgccagtattcacccgccgtggaaaccggtggcggcaggaccgatagcttatctttgatcagtttcaggttgtagatcgacttgctatcattcggccttagcatcagccaggcgcgggctttacgccactcgccttcgcgtatccaggttagcgccacgttgttgtaggccgtcgcgatggcgttgtcgtcaagggcgcagctttcgctccatgcggccagctgttcaaaagcgtcgagtgctttggcatacttttgggtcttgtaaagctgttcgccctggctggccaaaactggaatttttgcgcagtcggcctcgatctgctgctccgtaatttcagccctggcggtggcgaagagtagaagcagggcgcaaagaaatagagattttctttgtattatcactccattacaccattgagttgacctgtcccggcagctctgaattcgggatacggacggtataccaggcgaaacgaaagcgtttccagaaagaatcgaaatgcaggtggtccaggcaatccataacgatttcattatccgggtaaagcgtgaaggcaaaatgtgcccagcgtgcgcttagcttcatattaaacagcgttcgatcgtgtttattaccgtgcaggcgcgatagggtcaccatagcgtgtagcgtgcctttgttggcctcttgttgcaccagttccagatgcttatgcgccagcgtaatatccttcacttcaaaaatattcagcaggaacaagccccaggcctctttatgcccgaactgatgcgccagccagagattatcgagcagttctttttcataagcggaacgtttttcggtatcaagttcttgtttactcagacgctggttgcagatgccgatgctgaaatgaatattttgcaggtcattttcatagtcggtatagcctccgttatctattaatttgtacggggtgctctcgcgcagcgctaaccgccggtgcaaaatctccgccgcgcgctgaaaataccctaacgcgatggcaggatcgtaaggtagtaggccgttgttctctttattattgtgttcaaggcccagcaggtttagcgcggcgggtatatttctttgtgcgcccagctctgccagcggcacaaaatgttccgggagcccgaaccagtcgaaatttttaatcgccgcccgccagttatggttatattgaatgtcggcgacgctatcgagccaggcgaggccttgcgcctcatccttttcgaaacccaataacccggcgtactgaaagtagccacgacggattttcggcactgcgaattccgtttgctgcgcattctgacagagaaaattatacatccaccaggtgtcaggaaaatcgcgcagggcgaactttatcgtgtcatcaaagaagtaattgttgaacttaactttttccacgatcgaacgctgaagggttcgccagagcgcgtcattatcgtccagatcgctatagcagacccgcagccacttcagcgtgttgtggcgagattcctggatatgcgctcgcaggctaatctcttcggctttggcgataatgcgttcctgttctgccggggagtcaacctctttgatgcgcagatcgcggtgatcgtcccaccagatcaatagctccagatgttcacgttctgcggcagaaaggtgatcgcatacgcttgattccagaaattcgcggatttcctcgtgagaccctccccagcgcggcatacgaaacgggatatattcatccagcacgtaaaatgccgtcgggaaaatagccaggcagacggcgagccagtatttttgcccggcatcgtcattgcactccggcagcacggacgggcgcggcaaatttgggcaaaccgcgtcggcaaacgacagcccggaatgggccatcagcgcatccacctcctgcggtgaatggcgatgatattcagccagatcttccattaatggctgcccggcaacatccgcgccctcgaggaactcaaccagccagtcgggctggccgaagacttttgagttggtgctggtcagggccgccgccatccactggcgcggttcacagtcgatagcattgagcgcggcgatgaccatccgttcgttgcaggcggcggcgcagatccacatcgctcgggtggtttctctcgcccagccatagctgcggtaaagccacgcacggtgattccagtattgcgcctcggcaagccaggcgtgagtggagcggggacgagcgcgctgccagtttttgatcagcgctaatccttgcggcccagcctcaaccagcgtgtccatatcgtaaaaagggttgtccatttgattccaggcgaagaaatagcgcttttccgcttcgcggctggtaaagctctccgtcagcgcctggttgtagcgttcgtccagttcgtcatagcgttcttcgcgcagcaggccgggaatatcggcgatatgccactctcgttgcccgtcattgaggggatttttgtggttgcacatctcaaacatagcgttgagcagacgatcatcctgttccataaatagtcctttaaatcggctcgaaaattttgaattcattccacggcagttgtcgccagcggctgacagggtcttgcagataatgggtggcttcctgtaaatcccgtccggcaagcgctattggcgtgtcacgtagcgtgagccatacccggcgggcgcgaacgtaggcggtggcgtaatcctcccaggaatcaaaacagtcctgagcgcgctgggcgttaagtaataacaccagccaggcctcgttttcgtcacaccagccgagcccggcgatacagcgggtcagaaaggcggttcgcatgcagtcgaaagccagcgcgtcgcggacctggccctgggccgccagatgatgataaaacgtgctcggcgagctgccgatgcccgcaggccagcggcgtaagatatcctcgaccttgtggcgtaacgccgcgccgttgaggttttcgctcaagcccagctctttttttacctgctgtgccagatagcggtgtttgtcatcgtcaagtttgaagaccagctcaacgcctttgatcggtagcccgttgcgccgggcgaggatatcagctagcgccagcgcccattgccgccgtcgggtatcgcgacgcagatccttcagacgatctttttctttctcctcggcgatacgggccgcaatcagcggtttgtttttttttgtagttgcgccagctaaaaaatagggcggcaataataagaacaatccagaacattattgcacctccttgatgacagggaggtaacgcgtggtttgtagcgtcaggctttcaatttcgaaaggttcactactggtgtttttcccggcaagcgtagggtgccattcatgccgtggaaacagcatttccgcagccgtcgccacgttaggatcaacaacctgaaggtagcgcagcgcctccggggcgctgtgcagcagcagccactgtaaagctaccgggggagtggggaagtgttccattaaatgaaaattgtcatgcagcacattgagcagaaaattgaggtcatgaatatgagtaataaatttccaacctgaatattccggcgtcgattcataaactattcccatcccttcgcaatcagcgtggcgctcaggaagtggttgcagatggcgtaacagagataaaacatcgttagcatatttcttaataggatggcgattttgcttacctttaatctgatcaatgctcaggccgttattaccaaccaccaggcttattgtgacgtggggaatattattgccgtcgcgcaggctgaacaggcgaagtttctgttgttcaatttgccgggcgtagtaatcgccgtagccgccggaaagcgcgcctttattatcaaaatctccgacgcagtgttgcatatgccaggattcatacgccatctcactgcgcaggccggggtttgttgcatcaagctcaaccagcacaccgttattcaccgccatcaccggttttagcgcctcgctgttggagggataccaaccttgttcacgcaggtgctgcattttttgatgctccgcttcgcgcattgccagcacggtaaagcagttgatgcgctgtagtttagtttccagccgcgttccttcctgacgcgaaagaaattccactaaatctctttccattgccacaagttgcgggtgctgaacgttaaggtagtaaaagcgctcatcgccacccaggcggggatttctgcatcagggctaaaataaacggcataatcagcgacggagcgcacagggtaaacgtgaggaaagtcaccaatgatccaacgataaaaatgattgcttaaccagcgctggatattttcgctatcgccgcgttgttggctccgggaaaaaatagatgattttacatttggcgcatttattatattgcgtggtttatagcggtgagatgacgtttctgtcataaaaatccatgtgtaattaagctggcattatgtttatgtatttttagattcacttaatgaattaatgcgcaataagtttaaaaaactactcacagtatatcggtaaactaaaaagagcggccaaataatttattgtccccgatcgcgttcgtcgtggttttcgggataccgctcggccaaatgaaagagggcagtgtgttaattccgccagaatagcgttggcggaaaatatcgtcttacgaccttgttattgttatgccaataatcattataccaggcgacacgcatccgcttcccagcgatatcccaccccgtagaccgcgcgtataaatgactgttcggcatccagcgattccagtttacggcgcaggtttttaatgtggctgtcgatagtacgatcggtcaccacacggtagtcgtcgtagaggtggtttaacaactgctcgcgggaaaaaactttacccggttcaagcgataaggtttttagcagacggaattcagcgggggttaaatccagcgctttaccacaccaggaggcctgaaagcggctttcatcaatcattaacgggctttcggcatcctgctgctggagttcgcgctgcggtttacagcggcgcaaaatggttttcacgcgggccacgacttcgcgtgggctgtaaggcttacagatataatcatcggcgccgatttccagcccaagcagccggtcgatctcttcaattttggccgtgaccatcacaatggggatgtcggaaaaacggcgaatctcccggcatagcgtcagaccatcgatacccggcagcatcagatccagcaggatcagatccggcggcgtttgacgcacatacggcagtaccttgtcgccatgattgatgagcgtgggggcgtaactcgccgcgcgtaagtagtcaataagcagctgtcccagcttgggttcatcttcaacaatcaaaatgcgcggcgtgttttcatcaatgggtaattcagtcatacttctctctgtaaatcgcgatccagcggtaactctactgtaatgctaaccccgccaaaaggcgaatgagcggcgtgaagatgaccgttatgcgcgtgtacaatattgacgcatatcgccagccccagtccagaaccgccgctggcgcggttacgggacacttccgtgcggtaaaaacggtcaaaaagcttttgtaactgctcatcgctgacgcccggtgcagaatcggcaaaggtcaggaataatgatttgtcgcgttgttcggcggaaatatgcaggccgccgccgctgtcggtgtagcgcagactgttttccagtagattattaaacagttgcatcaggcgatccgggtcgccgaagacggtcatactatccggcaacgcgtaatgtagcgttagcccccggctggtaaagcgttctctaaacgcgccgccagcgacttccaactggggaacaagatcgacggtcgttttttggtaagccagcgcgccctcgtcagacaacgacagctgatgcaggtcgtcaaccagtttggtaagcgtaccgacttccgcctgtagcgaggtaaccgattctggcgtgaactggcgaacgccatcctgaatggcttccagttcgccgcgcaataccgccagcggcgtgcgcagttcgtgggaaatatccgccataaagtcgcggcgcatctgctgatttttttccagcgtgctggcaagctggttaaagtcttgcgccagttttcccagctcatcggcgctggttggggtcacgcgcgtggtaaaatcccccgccgccagcctgtgcgtaccctcgaccaaccgtttgaccggggcgagcaggccacgcgccagcaaaaacgtcgccagcgcggccagcaaggttgataacgccacgatcatccaactggcacgccgctgctgcatatcaaaattaatatccgtattgcgcgtcagccgctcgacaggagaggcgataatcgcgcctacttcgacgccattaaccagaatggggcggcgagtaccgtcatgcggcaccggaccgcgtgggccgaccagcacccggccattttgatcgacgacccagaactgggtgcgccaaccgtgcggcggcataccggggccgggtttatcccggtcgttgtcatgctcaaatgaacgcagaatctggaaaacgaagcgatcattgttacgtaaaaaacgccagttgccgtgttgctggtactggtcgcccagcgcatcgcccagcatttgtagccgctgctcgttgccgtgtttgatatagtcaataaatccgcgttcaaaactgacgcgcacggcccaatgcatactgatcagcagcacgatgcaggtggcgaaaatcgccagaaacagcttgccggtgattccgggccgccagactttcattacaggctccttttacgccgtgaaatgaccatgttttgctgtgtatcgttcggcacgcgggcaaaaattatcgccggtagcgcgataataaccgccatacataaccaggtgtacataaagacgtgatgtgtggcgctactgtctatcccgatatgctgttggccaaacatacccagcagcattccggcaatagtgacgccaatactcatcgagagctgcataatcatcgataataagctattgccgctgctggccagcgtatcgggaaggtcttttagcgttaaggtattcatggaagaaaagcgcgccgagttcaccattccctgcaaaagcagtaccagcggcaggagataataccagccgagcagcgcgaccgacataaacaacaggctaaccaatgccagtccgagcgtggtcgctaccagaacccgacgatagccaaaacggttaactatctgcaccacaatccgcttcattcccatgctgcccagcaccatggggatcatcatcaaaccggcatgaaacggtgaaaaaccaagaccaatttgtaaaaagaccggcgtcataaacggcagcataccgctgccgatacgcccggcaaaactgcccagcaaccccagtgaaaacgtgggcgtgcggaacaatcgcaggctgaataacgcacctgagttttttttggcatggaagagatagagcagaatggctgccgcgccacccgcagcaagtccggctaatgtccagggcgaaatccccatgcttttactaccgtccagcgccagcgtgagtaccgccatgccgatagctaacagcaggaaccccggcagatcaaagcgccgggtctctatggtgtagtttggcatcagcataaaggtcgccatagcgccgacaattcccaccgggatattgatcagaaagatccagtgccatgaagcatattccaccagcaccccgcccagcgcggggccgagtaacggcccgatctgtcccggtagggcgacgaaggtcatcgccgccatatattgcgcacgcggcacgattttcatgaccgtcaggcgtccgaccggcaccatcatcgcgccgcctacgccttgtaaaactcgcgctaataccagttgattaagcgtaccggagagggcgcaaaacagcgaacccagcgtgaacagcacgatggcggcaaagaaaatattacgcacgccgattttgtctgccagccagccgctggcggggagcatcacggcgacggtgagaacatatgacaccactaccatgtgcatatgcagcgggctttcccccaggcttttcgccatggaaggcagcgcagtgttgacgatggtggtatccagcgactgcataaaaaagccgaatgccacaatccagagttgccagcgggtgttgtcaggaaattctgtcatatctctactaccggtttgctatttttacgcgaaaaacgcagccgcagacggtcgaaaaagaggtacaccaccggcgtggtatagagcgtcaggagctggctcatgaccaaaccgccgacaatggttatccccagcggctgccgtaattccgaaccgtctccgccagataacaccaatggcagtgcgccgaacagcgccgccagcgtggtcatcattattggacggaagcgtaacaagcaggcctggaaaatggcttgttccggtgtcaggccgccgcttcgttgcgcttcaagcgcaaaatcgaccatcataatggcgtttttcttcacaatgccaattaatagcatgatccctatcagggcgattaggctgaaaggggcattgaagagttccagcgccagaagcgccccaacgcccgccgatggcagagtagagagaatggtcagcggatggacgtagctttcgtacagtatccccagcacaatgtagacggtagcgatcgccgccactatcaaaataagctgtgaattcatggtctgctggaagacttgcgccgttccggaaaaactgccgcgtaccgtcgaggggacgccaagctgcgtcatggtgcgatcaatggcctccgtcgcctgcgataacgatgtgccggtcggcaagttaaaggcaatcgtggacgctgcggaaagtccctgatggtttaccgacagcggcgcattggcgggccgccattgggcgaaataagagagaggaatcgcttttccgtcgcggttgataacgaacattttctccagcgcgctgatatcctggctatagcgcggatcgacttccatcaccactttatactggttcatcggctgataaatggtggaaatttgccgctggccgaaagcgttatttaacaggctgtttgcggcctgaacatcaatgcccagccgtgacatggtgtcgcggtcgtagataaggttcatctccgcgccgttatcctgctggtcggagtttacgtccgccagttgcggcagggccgagagcgctttgcgtattttcggctcccactcgcgcagcgccggcagggagtcagacagcaacgtatattggtaactggcgttagcctgccgcccgccgacgcgaatatcctgtaccgccatcagaaacagcttggcgccgggttcttttgccagtttgacccgcagtcggtcaatgacttgctgcgccgtctctttgcgttcgccgcgcggcttcagcgtaataaacatcatgccgctattcaccctcgatccgccggtaaaaccagtgacattattcaccgccggatcgtcgcgaataattttcataaaatcctgcagcttgccgcgcatggcttggaaagagatgctctggtcagcctgaataccgcccatcaacacgccggtgtcctgctccggaaagaatgttttagggatggcgatataaagccagatgttcagcgcaacggtgccaagaaaaaccacaccgacaagacgcgtatggttaagcacccattttaacgacgtgccgtaaccctgttgcaaggcgaccagcaaacggccaacgccccgtttacgcggttgggtgcgcggtttgcttgatttaagcatccagccgcacatcatcggcgtcagtgtgagcgagaccaccagcgaaatgccaatcgccaccgagagggtaacggcgaattcccgtaataatcgtcctggcaggccgcccattaacagcagcggcagaaataccgccaccagcgacagactcatggagatgaccgtaaacccgacttcccgcgtaccctgtaatgccgcctgcaaaggtttcattctcgcctccagatggcgggcgatattttccagcaccacaatggcatcatcaacgacaaatccggtcgcgatagtcagcgccatcagcgacagattgttgaggctgaagccgcacagatacatggcggcgaaggtgccgatgagcgaaacgggaacggcgacggcggggattagcgtggcgcgcccggaacgcaggaataaaaacaccaccaggatcaccagcgcgacagagatagccagcgtctcttctacctcttgcagcgatgcgcgaatcgtcggcgaacgatcctgggcgatttgtaaatcgatagcggcggggatcattgcccgcagttccggcagttttgcccggatgccgtcgaccgtctgaataatgttggcctccggcagcttgcggatcatcaacaaaatagcgggtttagcgttcgtcatcccggcgttacggacatcctgcaccgagtcggtgacgctggcgacgtcacccaggcgtaccgccgcgccgttgttatagtgaataatcagcggctgatattcggcggcggttttcagttcgtcgttggtctggatttgccagcggtggacgctatcttcaattgcgccttgcggtcggcgtacgttggcgctgtcgatcgcttcgcggacctcatccagcgagacgccctggttaaagagcgcctgcgggtttaagcctacacgtactgcgggcagggagctgccgccgacgtcaacgtcgccaacgccgtcaatttgcgcgatggtttgcgccagttgggtagaggcgaaatcatacagtttgccctgtgaccagctctctgaggtgagcgttaaaatcataatcggcgcgtcggacgggttggccttgcgataagtcgggcggctgggcattccgcctggcaacaagctttgcgcggcgttaatggcggcctgcacgtcgcgcgccgcgccgttaatatcgcgatcgaaattaaattcgagaataatgcgcgtactgccgagcgagctgctggaagtcatttcattgacgcctgcaatgcgtcccaaagaacgttccaacggcgtcgccaccgacgaagccatggtttccggcgaggcgcccggcagcgaggcgctaaccataatcactgggaaatcgacctgcggcagcggggcgaccggcagcagacgaaagcccagaatgccgcacagcgtaatggcggcggcaatcaaaatggtggcgaccgggcggtagatgaaaagggcgaaaaagcgcatctacgcctcctctttatggcgcggaaagcgacttttcacgtacagcgacaggcggtcaaacaggagataaatcaccggagtggtaaacagagttaatacctggctgaccagtaagccgcccaccatcgcgatccccaacgggcgacgtaattccgcgccaacgccggtactcaacattaatggcaatgccccgagcaacgccgccagcgtggtcatcagaatcggtcgaaaacgcagcagacaggcctggaagatagcgtcgcgcggactcatcccctgttcgcgttcggcggcgagggcgaagtcaatcatcatgatggcgtttttcttcacgataccgatcagtaaaataatgccgataatggcgataatatcgagctcgctaccagcgatgatcagcgccagcagcgcgccgacgcccgccgtaggcagcgttgagagaatcgtaatcggatggataaaactctcatacagcacgccaagcacgatatacatcgccaccacggcggcgacaataagccagacggtgctgcccagcgccgcctggaaggcgagcgtactgccctgaaactgcgttgtaatatccgctggcagggcgagcgttttttccgtatcgagaatcgcctgcaccgcatcgccgagcgaatagccctccggcacgttaaacgaaaatgtcgtaaccgggaactgatctaaatgattgatggagagcggggcgaagcgctgctcaatgcgggcaatcgcgctgagcggtacggtgccgccgtcgcggctcgtcaggcgaatcgtctccagcgccgccagacccggcgtgctggcggtattatgttccagcacgacgcggtactggttcgcctgggtataaatcgttgaaatcaggcgttgtccgaacgcgttgtagagcgcgttatccacatccgccatgctgatacccagacggctggcgctgtcgcggtcgacattcacccaggccgctaatccccgatcttgccagtcgctgcttacctcagagagctgtggtaacgactgtagcgcgttctgcagttttggcacccagtggctgagcgcatcgagcgtcgtggcctgcagggtaaactgatactgcgtgcggctgacctgcgtgtcgatggttaaatcctgcgtcggctggagatacagcgccacgccgggaatcgtcgccacggcggtttgcagccgggagatcacctgctgcacgcggtcatcacgcgcatccagcggcttgaggttaatttgcaggcgcgcgctattcagcgtgggattagcgccgtctacgccaacaaaagtcgtcaggctttgcaccgccgggtcctgtaatatccgctccgccacctggcgctgacgttgcgccatactggcatacgatgatgattgtggcgcctgcagcgtcccctggataatgccgttatcctgtaccggaaagaaccctttcgggatggttatccacagcataacgctgagcaggagcgtggcgaatgccacgctcaatgtaagccatggatggttgagcactttcgctaatccgcgtccgtagctggcgatcacgcggtcaaacatccgctcgcaggcgcgggaaaagcggttttgtttacgcagagactgccggctgagcatacgcgcgcacatcatgggcgtaagcgtcaaagagacgacggcggagattaaaatcgctaccgccaacgtcaccgcaaattcgcggaacagtcgaccaacaatatcgcccataaagagcaacgggatcagtaccgcaatcagggaaaaggtgagggaaataatggtaaagccgatttcgcccgcgcctttgagcgccgccgccagcggtttttctcctttttcgatgtagcgcgagatgttctcgatcaccacaatcgcatcgtccaccacgaaacccgtggcgatagtgagcgccatcagcgtcaggttattaatggaaaaatccaaaaacaccatcactgcaaaggtgccgataagcgacagcggtacggcgacgccgggaataattgtggcgggaatattacgtaaaaacagatagataatcatgacgaccagcgcgatcgccagcatcagttcaaactgggtatcgcgcacggaagcgcgaatattggtggtgcgatcggacaggaccgtgaccttcaccgatttcggcaggctttcggtaagctggggcagcatctggcgaatgctgtccgctgtcgcaatgatattggcgccgggctggcgttgaacgttcatcacgatagccggagcttgattcgcccatgcgccgagccagctattttccgccccctgttcgacggtggcgacatcgcccagccgtaccggcgcgccgttttgatacgcgatgataagcttgcggtattcgtcggcagactgcatctgatcgttagcagaaagcgtcaccgcccgttcggggccatccagactgcctttcgccgagttgacgttggcgccggtaattgcggtacggactgtttcgctggtcagaccgagcgcggcgatagcctgagcattcagttttacgcgtaccgcagggcgctgcccgccggcaagcgtcaccagcccgacgccggagacctgtgagatcttctgcgccacgcgggtttctaccatgtcctctacctgggtcatcggcatcgcgtttgaggtgacggcaagcgtcataatcggcgggtccgccggattgactttgctataaatcggcggattcggcaggtcggaaggcaataaattggtggctgcgttaatcgccgcctgtacttcctgctcggcaacgtccagcggcagcgtcaactgaaactgtagcgtcaccaccgatgcgccgccggagctttgcgacgacatctgcttaagtcctgacatctggccgaactggcgctcaagcggcgcggtgacggaggaggtcatgacatccgggctggcgccagggtagagcgtaaccacctgaatagtggggtagtcgacctccggcaaagcggcgacgggcaggaagcgatagccgataatcccggcgagtaaaatcgccgccatcagcagagtggtggccacggggcgcagaataaacagacgcgaagggccgcccgtgctgcccggaggtaatacctgcatcaggcgcgcgctcctttttgaccttcatggcgggaaggggatttttcatccgccatggtggtttgcggctcaacgacctcgacttttgcgccttccgtcagccgatcaataccatcggtaacgacgcgatcgcctgccgacaatcctgcgctgatcaccacgtttcggttatcctgaataccgatttttacccgcttcttgctgacgttattttcgtcgttcagcacccacacaaagtggccctcattgcccatttgcaccgccgcggcaggcaccacaacggcattttgttcggtatcgaccagcatccgggcgttcacaaattgattggggaacagcgtatcgtcctgattggtaaagcgcgctttaattttgatcgttcccgtcgtgggatcaatctggttgtccagactgagcaacacgccttcgctcaatttgtgcgagttagttcgatcccaggcttctacgaccagcgttttccccgctttctgtgcctgaaccacggtcgcgatatcgctttccggcagagtaaaaatgagatcaatcgggtgcgtttgcgtaatgacgacaatacctgcggtatcgctgctggaaatctggttgccgacatccacctgtttcagacccacgcgtcccgagaccggggctgtgatacgactccagtcgagctgtagctgcgcgctggcgacattggcttcatccgctttaatggttccctgggtttcgttgaccagcgcctgttgcgcatccagttcctgacgggaaaccagattggttttggccagttgctgatagcgcgccagatcacgacgcgcattcgccaacgtagcgttatctttcgctaactgtccctgagcctgcgccagggcgaccttaaactggctgggatcgatttgcgccagcagatcgcctgcgttaacctgctgaccttcctgaaagtgcagggcgatgagttgaccatccacgcggctacgcaccgtaacggtattcgctgcggtcacggtacccagcccgctcagatagcgcggtacagcctgtgtggtcgcggtcgcggcctgtaccggcgccagagggccgtcgcgcataccgcggcgacctgcggcggcggtatgctgcgcttgcgcggcgacgcccggcgcggcggtcgggctttcgctacggctatgccagaaccagaatgcggcggcggccactacaaccccaatcgctattgcccagcggaaagtattactgcctttcatcggtataagtttctcatcctgaaacgttttgcggaatgttgcttcctctattgtagtcagcagggaagggagaaaaatggaggaattatggaacacggtcgggattattctgaatggcgacccgctttgcgaggcgctacgcaactctcatcggtgaaaatcgttaacgcgccggagtgcggtaaagtgccggcacggcaatgaagataagccaccgatttcagcaggatgctgaaacgggaaagcccctcccgaggaaggggccaaaataaggaaagggttatgatgaaggtagtcatcataatggtgatactcttagtgattagcctaccagcttactaagacaccagggggaggaggaatcctcccttaccctcactcctgacgttaagccacatcaagaataatgtcaatccatcagcgctgggcttgcgaggcgcttagcggaaaacgacctccgcccagcgcgccagtcctgcggtgacggagccgaaatcatcgccgccagcgacgggtatgcccggtagctgttcggaaagcgcttttttaatcaatggcgaacgggcgctgccgccggtcagatagatgacatccggtttttcctgcgcgctgtccagcgccagttgcacctgttccagaatacgcgccagcggttgatccagcgccgcttccagtccttgctggctgatagcgaccgccaggtcgtcgctgataaatggcagcctcgccgtaacatccgcctggccggaaagggcgattttgctctcttccgcgcagcgtaccaggcggtagctaagccgctgacgccagaccttgagcagcaacgcgaccttgtctgcttcacgcgcgttgcgaaccaaatcgttcaacagacgaccattcgcgctactgtaaaaatcgctttgcgccgggacgtcgttaatcgcgacggcgttccaccacggcagcaccggcagggcgatacctttttcggtttcgccgcccatgcccagcaaaggcatcagatttttaaaggccagcgcgatatccagatcgtttccgcccacgcggcaaccgctgtgccccaacaggctgttttcacgatcggcgcgctgacgccactgcggccccatcagcagcatggaacagtcggtggtaccgccgccaatatccacgaccagcacacgcttctcttcccgcagcgtagcctcgtagtccaggcccgctgcgaccggttcatactggaataccacctcctgaaaaccggcgcgttttgctgcccgctccagaataccctgcgcctggcggttcgcgtcatcgccgccgagtccctgaaagttgatcgggcgaccgatcaccgcctgagtaatggcctccggcaattggctgtgcgccgtatgaagaatatgtaccatcatggcgcagaccaaatcttcaaacagcgcgacctgctgcggtttcaggccgctggcgcctaaaaaggatttcggcgatttgacgaaccagacttcctggggatcgtcaatatagtgcgccagcgacgccagaccaaactgtacgctttgcgcgccaacctcaatatcttcctcgcggttgtagcgtatagcgcggcgtagcagcgcctgggtttcttcgtccgttgccggcacatcatgatggcgatacagccactcgctcaccgcttcgcgcgtcggcgcacacagcatagacggcagtaatgcgctgttattctccattgtcagcaactgtggatgcccgtcgcgcataatggcgaccgagcagtttgccgtaccgtaatcaaatcctataaacaccttaaaatccccatgccagtgaagaaggggcgtgactttagcgaaatgtcgtcgcggcgacaactggaatatgaaagcaaggcgttacgtgcgattagcgtttatgctgaaaggtcaaataaaggagaaaagtatgtttaccctgagctggcagccgccttacgactggtcgtggatgttgggctttcttgccgcgcgtgcggtggacggcgtggaaacagtaggcgagggcttttatgcgcgcagcctggtggtgggcgagcatcgcggactggtcagcgtgaggccccatctgcccacccacactgtgcaggttagcgtgagcgccggattacttcccgtcgcgccggcgtgtctggcgaaagtttcgcgtctgtttgatcttgactgccagcccgagcaggttgccgccgtgctggggccactgggcgaggacagaccggggctgcgtttaccgggatcggttgatacgtttgaacagggcgtgcgggcgatactggggcaactggtgagtgtcgcgatggcggcaaggttgacggcgaaagtggcgcgccgctatggcgaggcgttgccggatgcgcccgattatgtctgttttcccggtccggaaacgctggcgttggccgatccgctggcgcttaaagctctggggatgccgctgcggcgcgccgaagcgctgattcatctggcgcaggcgacgctggcgggaaaactggcgctctccgcgccgccggatattgagcagagcgttaaaaatttacaaacatttccgggaattggccgctggacggcgaactatttcgccctgcgcggttggcaggcaaaagatatctttttgcccgatgattacttaattaagcagcgcttcgccgggatgacggccgcgcagatccgtcgctacgcggagcgctggaaaccgtggcgttcctacgcgctactgcatatctggtatacccacggctggcaaccgtcaatggatagcgaaatagctggtattcagtaacaaatccagcggttgcgcttcggcgatagtgtcgccataaatcagatccacgccaatacgggagagcgtatccagcacctgtgggttttgtaccggcccggcgagcgttttgatgtccagatgctgggcgtgtccctggatgatcgaggtcagcatttcatccattaaactttcatgaacgttggcgataaggtcgctatccagcagtaaataatcgacgatatgcgggggcagtaaattaaacagctgtaaatcgcgcccgacatggctgagaatcacctggcagccgcgttgccgcagttttcgcagagtcgcagcggcggtctgcgcctgcttaacgataacgtcagccgggataatcaggtgtaataaccgtggcggcagtgggctatgctccagttgttccagcagctcatcaataagggtcgcgctgtataatcccgcggcggacagcggcagcgcaacgcttaatcccttgctggcgacggcggtcgccgcatggcggaaaaactcatggaatacccgtcggtcaagcgcgtgatgcagcgcggagtcggctaaccctgcccggaacgcgcgctcttccatcacttccccttcgctggtccacagcctgagtgagaccagccaaaagctggtggcctccggcgtacgcggcggcgcgacgtttctggcaagcattagcaggaggttatttttaatcatatgccactgttcttccagcggcatcattccctttgaggaggttaatgcgtgctgcggttcgtacacggtcagacggcctcgaccgctatttttcgcggcgtagcaggcaatatcggcctgagacacgacctctgtgagctggcagttatgttcatttatcattgtgatcccggcgctggcgccgatccgatgcaggcgtccttcccacataaagtgatattcattaacggcgttgataagccgcgtcgcgataaagcgcgcgctgtcactattacaatccggtagcaacaggccaaactcatcgccacccaggcgggccaggagatcgccggagcgaagcatactgagcatcagtgacgcgagctcgcgcaataaggcatcgccggcggcatgtcccgcgctgtcgttaaccgctttaaaacggtccagatcgataaacaccagcgcatgatgttgaggcgattcctgtattgtttgcaggcgctgttgcagctgtttttcaaaactggcgcggttggcaagttgggtgagggcgtcatgcgttgcgctgtagctgagctggcgtaacatttttcgtgattcggtaacgtcctggataaccagaaccgaaccaatcttatcgccgtcaagcgtactgagcggcgtgatactgtaatgaatatcgtagctaccgccgttatgacaatggagcactatctcctgttccatgtccgatcgcgacctgttggcgcgataaatatcctccagcagcggccccttattacctgacgtaatgcgcagaaccgttaataatggcgcgcctaaagcatcctcttgccgccagccgctcatcttctcggcgatcggattcataaaggtgatattcatcgcgacatcaatacacaccaccgcttctccgatagagtcaagcgtgatgtgcaaccgttctttttcctgaaacagcgcctcgttcgcctgtgtaatacgctccatcaaccgctggttttcctgctcgctttgcttgagatcgttaatatcttcaatctgagcaataaaatagagaggttgattgtctttatgacgaaccagcgagacggccagcagcgcccagacgacatcgccgttgcgggtgtagtagcgtttttccatggaatagctgttgatgtcgccgcgcaccagcatgtttagctgttcaaggtcgttattcaggtcttccggccaggtcaattgctgaaatgtcatcgtgcgtaattcatcctggctatagccaagaaaatggctcagagatttattgacctgtagccactgaccctccgtaccgaccagcgccataccaatggcggaatactccatcgcgttgcgaaagcgggattcgctctcggtgatatgtttgcgctccgtgcgaaacgcgtacatcaccatcgtcatcatattggcaggcagcaggatcattaaaaaaggcagccacggcatattgaccatcacgtcggttttcggcgtggcgagcagcgtggggtcattggccagcatgagcgagaccacgataacggtagctaaaaaaattaaaaacgcctccattcgcggcaggcgcaccgcactccacatcaacaggacgataacgcacgtaaacggccacggaatatagcgcatagcgagccagcttagcgccagcgtaatgaccagcgtcaatagcgtttccagcaacagatgcgggtcgcgatgacgcaacagatagtgtggtttaaacagtaaacctaacggcaccagcgtcagcgcgccgatggcttccgataatacccaaatcagaaacgctttcgaggcgaccgcttccggcgctatcagccaaaataacaggccgccgagtagcggcggaatcacggcgctgccgatagccagacgaaaccagtcattcaaattttgtaaggggttgtagctggggagcagttttcgtagcagtatcgcgccagtggccgcctcgataatatttattgccgtccagctaaagttaagcgaggcggcaggaaataaagtcagtgaggcgccgatgctgccgagcgagcaggcgaccgcgatcccaggccacagacggcccgcatggcggtaaaacgcgaccatcataatggaggtggggaaccacagcggcgcgagttgggtgccgacacgcgataatacgagcgaaaagagcgtaaagacaaacgcgaccaggcctaaactgaccagacgcaatagcgggtgggggacggtaacgaaaacatgttgggatggtttactcattaccactctatccgaatcgccggtaacgtcgcggaataccggacgcgtcagtttactctgtgattatgctagtataaacgcgtaatgatttatacgctgactgaatataaattgtggctcccggcgtattcctcctccagacgggtcgataaatccgctgtccgcattaaaactgaacgcttttacgtcgcgacgtcgaatgcgccgccaacaaattcaccgtggcatagcgccggactggtatcgcgctgctgaaatccctataattgccgcgtttggcgtttcggcgccccccttctttacatccaggttaatcaggtcgctaaatttatgactgatcagtctcatcagtgcgtcattatcggtatcgctggcgcatcggcttccggcaagagtcttattgccagtaccctttaccgcgaattgcgtgaacaagtgggtgacgaacatattggcgttattcccgaagacagttattacaaagatcaaagccatctgtcgatggaagaacgcgtaaaaactaactatgaccatccgaatgcgatggatcacagcctgctatttcagcatcttcaggcgctcaagcgcggttcggcgattgaattaccggtatacagttatgttgagcatacccgtatgcaggaaacggttcgcgtagaaccgaagaaagtgattattcttgaaggtattctgttactgaccgacgcgcgtttgcgtgaagagatgaacttctctatttttgtcgatacgccgctggatatctgtttgatgcgccgtatcaaacgcgatgtgaacgagcgtggtcgctcaatggattcggtgatggcgcaatatcagaaaacggtgcgtccgatgttcctgcaatttattgagccttccaaacaatatgcggatattatcgtgccgcgcggcggtaaaaaccgcatcgctattgatattctgaaagcgaaaatcagccagttctttgaataaatctggcgaattgtgtaccgttcagtgataacctggttagcccttgatgtgcttgatttaagggcttgatgcgcgaaaggagaaagtgccatgcgtttatgcgaccgagatattgaagcctggctggatgaaggccgtttgtctatcaccccgcgacctcccgtagagcgcattaacggcgcgacggtcgatgtacgtcttggcaataaatttcgaaccttccgtggccatacggcggcgtttatcgatctgagcgggccgaaagatgaggtcagcgcggcgttggatcgcgtgatgagcgatgaaatcgttttgccggacggcgaggcattttatctgcatccaggcgaattggcgctggccgtcacctttgaatccgttaccctgccaccggatttagtgggctggctggatggtcgttcctcgctggcgcgtctgggactgatggtgcatgtgacggcgcaccgtatcgatcccggctggtcgggctgcattgtgcttgagttttacaactccgggaagctgccgctggcgttgcgtccgggtatgctcatcggcgcgctgagctttgagccgctgtccggcccggcggcgcggccttataaccgccgtcaggatgccaaatatcgcgatcagcagggcgctgttgccagccggattgataaagactgagccattcggcgcaatactgccggtccattgagggtagcatgagacgatttctgacgacgctgatgattctcttggtcgtgctggtggccggattctctgcgttggtattgttggtcaatccgaatgatttccgcgcctatatggtgcagcaggttgccgcgcgtagtgaatatcagttgcaactggacgggccgctgcgctggcacgtatggccgcaactcagtatcctttccgggcgaatgacgctaacggcgcgaggcgccagcgaaccgctggtgcgggctgacaatatgcgcctggatgtcgctttatggccgctgttgagtcatcagcttcatgttaagcaggtgatgctgaaaggcggggtgattcaactgacgccgcaaacggaagcggtacgcagtgatgatgcgccggtcgcgccgaaagataataccttgccggacgtagcggaagatcgcggctggtcgtttgatattcgtagcctgcgcgttgccggcagcgtgctggttttccagcatgaaaatgatgatcaggtcacggtgcgcgatattcgtctgaatatggaacaagatgccgagcatcgcggcacgtttgatttttcgggacgcgtgaaccgcgatcagcgggatcttgctttatcgttcagcggaacggtggatgcttccgattatccgcataatttaaccgcgggtattgagcaactgcgctggcaattgcagggcgcggatctaccggcgcaggggattgaggggcagggacaattgcaggcgcagtggcaggaggcgcaaaaacgtctttcatttaaccacttaaatttaacggcgaatgacagttctctgaccgggcatgttcaggtaacgctggcggagcagccggaatggcaaattgacctccggtccagcaagcttaatctggacaacctgttgccgcatcatagcgccgtggctcagacaggcggcgcggtgtcgcaggggcaaaatacgctccccctgaccaggccagttatcgcgtcgcgtgttggtgcgccgccttatcaggggctgcaaagctttacggcggagattgctttacaggcggattcagttcgctggcggggaatggactttacccaggtttcgacgaagatgtctaatcagaccggattgctggatattactgagttgcaggggaaactggccgacggagagatgtcgctgcccggcacgctggacgcccgcaccgccagtccgcgcatcgaattccaccctcgcctcaaccatgttgagattgggactatcctgaaagccttcaattatccgattagcctgaccggtaagatgtcgctggttggcgatttctccggggcggatattgacgcagaggcatttcgccatagttggaaaggaaaagcgcatgttgacatgagcaatacgcgccttgaaggaatgaatttccagcaactggtgcagcaggccgtagagcgaagcggcggcgacgcgcagcagtcgcaggaaaatatggacaacgcgacccgactggatcgcttcacgaccgatctgacgctaaataagggcacgctgacgctcgacgacatggtcgggcaatcttctatgctggcgttaaccggcagcggaacgctggatctggttaagcagagctgtgatacacaatttaatctgcgtgtgctgggcggctggaacggcgatagcaacctgatcaccttcctgaaagagacgccggtgccgttgcgcgtctatggcaagtggcaggagctgaactataccctgcaagtggagcagttattgcgtaagcatttacaggatgaggcgaagcgtcggctcaatgactgggcggatcgcaataaagatacccgcaacggtaaagatgtgaagaagctgctgaataagctgtagtttttggccaaagggcagagccggatggcgaggctaacgcgcctccggcctgcctggtaagcaggccggggcaggcgaacagacgttacatctcctggtctggctcgccgttatgcagcggaattaactgcactttctgcactcgatggctttctacctgcaatgttttcagcaaataatcgcccacctgaacctcttcaccggtttgcggtatgcgttgcaaatattccatcaataatccggcaatcgtatggtattcccgtttttcatccagcggtagcggcacgtactgcaccaaatcctccagcggcatatggccgtttgctgtccaggaactgtccgggttcttctgaatatcgtggcgggcgtcaatttcctcgacttcattcggcagattaccggcgatagtctccatgacatcgcttaatgtcacaatgccttcaaccgagccaaactcatctacgacaaaggcaaaatgggttctggcgttacggaactgctccagcgcaggcagcagcggcaatgtttccgggaaaaccagcggttggcgaatcagcgcccgcaggttgagcggttcgccgcgcagcgattgttgcaacagatcgatgacgtggacgacgccgagtaaatcttcctgttcattttcacccgtcacgaccagacgcgtatgctggttcttttccagcagagcgcggatttccgcttccggcgcgttgagatcgatatgctcgatatcgtgacgcgacgtcatgatgctacttacggtgcgctggttgagattcagcacccgctcaatcatcctgcgctcctgcggattaaaaatctggctgtcgtcatggtctgccagcatcgcggcggtttccgcatccagttcggcatcctcttttttaccgctaatcagccgcatcacggcctccgttgtgcgctggcgcagcgtatggttagcggaaagaaaacggcggcggttaaaaatagccagttggttgagcgcctcgatcatcaccgagaagccgatagccgcgtacagataccctttcggaatgtggaaaccaaacccttccgccaccaggctaaagccgatcattagcaggaagctaaggcacaaaatgacaatggtgggatggttgttcacaaatcgggtcagggacttgctggcgagcagcatcaggctaatggcgattatcacggccgccatcatgaccgctaggtgatcgaccatccccacggcggtaatcacggagtcgagagaaaagatagcgtccagcaccactatttgcgcgaccaccgcccagaatttcgcccccttacgctgggtagggttggcgctatctttcccttccagccgttcgttgagctccatggtggctttaaagagcaggaagaagccgccgaacagcataatcagatcgcgggcgctaaagcttaacgcctgtacgctaaagagcggcttagtcaaggtgaccagccacgagattgacgccagcagcagcaggcgcatgatcatcgccagtatcaggccggtaatgcgcgcgcggtcgcgctgccccggcggtagtttttcagcgaggatggcaataaagaccaggttatcaatgccgagaacaagttcgataacgattaacgttaccagtccggcccagattgacggatcggcaatccattccatagtaagagcaataccttctgtaatatgacaattgtcacaattcgatcatggataatacggcggaaaaatgcaatgccgcagagcaatttatctttgttacggggctataaaataactttaaaatagccgtaatgtttctgtcggaaactaaataatgtcaagaatatatttaggaaatatcgcaggtggagtggagtaaataaatattgtcaacatcaataaaatcctaaaatcatctgttaattcatttaatattaatcttaaaaatatagaatggcgggtttgttaccttgcttgtcattaggttagctgcaacaattcttgcaggattaagatagcgcgcttaaatatcctgtcacgacatcgagaaaactattaatacgtaacctttatttcgctgaagatttttatctgaacgaggatgaaattggaggggaatgcgaaaatttagaataatcagtgtattggtagctaagaagctaggggcggtagcgtgcctgaaagcctgaatataagactttattattctgtcaatagcctgcggatgaattgatttttttcagaatgatgccagttaattttctctgccattaactgcaaggtaaatgtgcacggacgaagccgctatttaaattgcacaggataatgactctgccaaagtgataaataatcaatgatgaaatccaaaatgaaattgatgccattattggcgtcgctcagcttgataagtggttgcacagtactcccgggcagcaatatgtctacgatggggaaagatgtgatcaaacagcaagacgctgactttgatctcgaccggatggtcaatgtgtatccgctgacgccacggctggttgagcaattacgcccgcggcccaatgtcgcgcaaccgaatatgtcgctggaccaggagatcgccagctatcagtatcgcgtcgggcctggcgatgtgctgaatgtcaccgtctgggatcacccggaattgaccacgccagcaggccagtaccgtagctcaagcgataccggcaactgggctcagccggacggcaccatgttttatccctatattggcaaggttagcgtcgtcggtaaaactttgtcagagattcgcagcgatattaccgggcgtttagcgaagtacatcgcagacccgcaggtggatgtcaatatcgccgctttccgctcgcaaaaagcgtatatctccggccaggtgaataaatccggtcagcaggccattactaacgtcccgctaaccgtcctggatgcgattaacgctgcgggcggcctgaccgatatggcggactggcgcaacgtcgtgttgacgcacaacggcaaagaacagcgcatttcgctacaggcgctgatgcaaaatggcgatcttagtcagaaccgcttgctctaccctggcgacattctgtatgtgccgcgcaatgacgatctgaaagtctttgtcatgggcgaagtgaaaaaacagagcaccctcaaaatggatttcagcagcatgacgctcaccgaagcattaggcaatgcggaaggcatcgatctgaccacctccaacgccagcggcatttttgtgattcgtccgttgaaaggcgaggggggacgcggcggcaagatcgccaatatctaccagcttgatatgtctgacgccacgtcattggtgatggcgacggaattccgacttcagccttacgatgtggtgtacgtcacgaccgcgccggttgctcgctggaaccgtctgatcaatcagttgctgccgaccattagcggtgtccgttatatgacggatacggccagcgacattcattcctggtaatcgttatgtttaacaaaatcttagtggtctgtgtggggaatgtttgccgttccccgacggcggaacgtttgctaaagcgctttcatccttcgctgacggttgcgtctgccggattaggcgcgctggtcggcaaaggagccgatcctgcggcggcgagcgtggcgagcgcccacgatctgtctttggaaaatcactgcgcaaggcaaatttccgcgcgcctgtgccgggaatatgacctgattctgacgatggagaaacgccacatcgccgccctgtgcgacattgcgccggaaatgcgcagcaaggtaatgctgtttggtcactgggacagcgagcgtgaaataccagacccgtatcgcaaaagccgcgatgcgtttgaggcggtgtacacattactggaaaggtctgcccgccagtgggcgcaggcactgaatgcagagcagggaaaaccatgacagaaaaagtaaaacaatctgcggcggttacgggtagcgatgaaatcgatatcgggcgtctggtcggaacggtgattgaagcgcgttggtgggtgttggggacgacggccatatttgcgctgtgcgcggtaatttatacgttcttcgccacgcccatctatagcgccgatgcgctggtgcagattgaacaaaacgccggtaattcgctggtacaggatatcaacagcgcattagcgaataagccgccggcttccgatgcggaaattcagctcattcgatcgcgcctggtgctggggaagaccgttgacgatctggatctggatattgccgtcaccaaaaacacctttccgctgttcggcgccgggtgggagcggctgatgggacgtcacaatgaaatggtgaaagtcacgacattcacccgaccagagacgatgagcggacagatcttcaccctcaaagtgctgggcgacaaacgttatcagttggtcagcgacggcggatttagcgcgcagggcgttgtgggccagccactcaataaagacggcgtgacgatgcgggtagaggcgattgacgcccgtcctgatacggaatttacggtgagtaaattctcaacgcttggcatgattaataacctgcaaaataacctcaccgtaacggaaaccggcaaagataccggcgttctgaacctgacgttcacgggagaggatcgcgaccagatccgcgacattctcaacagtattacccgtaactatctgcaacaggatattgcgtggaaatctgaagaggcggggaagagcctggcgtttctggcaaaacaactgccggaagtccgcagccgtctggatgtggcggaaaacaagctaaacgctttccgccaggataaagactcggtggatttaccgctggaggcgaaggcggtgctcgattcgatggttaatatcgacgcccagttgaatgagttgacgtttaaagaagcggaaatttccaagctctttaccaaagcgcatccggcttaccgcaccctgctggaaaaacgtaaagggctggaagataaaaaagccaaactgaacgggcgggtgacggcgatgccgaaaacccagcaggagattgtgcgtttgacccgcgatgtggagtccggccagcaggtttatatgcaactgcttaataaacagcaggagctgaaaatcaccgaagccagcaccgttggcaacgtgcgcatcgttgacccggcgattacccagccgggcgtgctaaagccgaaaaaggcgttgattattctcggcagcattattctgggattaatgttatcgattgtcggcgtgctgctgcgctcgctgtttaatcgcggtatcgaaagcccgcaggcgctggaggagcacgggatcagcgtctatgccagtattccgctgtcggaatggcaaaaagcgcgcgatagcgtcaaaaccattaaagggattaagcgttacaagcagagccaactgctggcggtgggcaatccgaccgatctggcgattgaggcgattcgcagcctgcgcaccagcctccatttcgccatgatgcaggcgcaaaataatgtactcatgctcacaggcgtcagctcctctatcggtaaaacctttgtttgcgccaacctggcggccgtcatcagccagacgcataaacgggtattactgatcgactgcgatatgcgcaagggctacacccatgaactgctcggcaccaataacgtggacggcttatctgacattctggcgggcaaaggcgagatagcctcctgcgcgaaacccacggcgatcgctaattttgatcttattccgcgcggtcaggtaccgcctaatccatcggaattgctgatgagcgagcgcttcggcgagctgatcgcctgggcaagcagccgctacgacctggtattaatcgacacgccgccgattctggccgtgacggacgccgcgattgtgggtcgtcacgttgggacgacgctgatggtggcgcgttatgccgtcaacaccttgaaagaagtggaaaccagtctgagccgttttgaccagaatggcattcaggtcaaaggcgtcattctcaactccattttccgccgggcgacgggctaccaggattatggctattacgagtatgaataccagtcagattccaaataaaaaataaggcgtgccggatggcgcggcctgtgactgtaggccggacaagcgtagcgccatgcggcaaaactatctggggaataagcatgacaacagacaatccgctgatctcaatttatatgccaacctggaacaggcagcagttggctatccgggcgattaaatcagtactacgtcaggactaccgtcactgggagatgatcatcgtggatgattgctcctcgtcttatcagcagctacaacaatttgttgaggagctgaacgacccgcgcgttcgttatactcataacgccatgaataccggcgcctgcgcggttcgcaaccaggccattatgcaggcgcaaggacactacattaccgggattgatgatgacgatgaatggacgcccaaccgtctgagcgtgtttctggcccataaacaccagttgactacgcatgcctttttgtatgccaacgactatgtgtgcgagggcgaggtctactctcagcctgccagcctgccgctgtatccgaaatccccttattcgcgccgcttgttctacaagcgcaatattattggcaatcaggtttttacctgggcctggcgttttaaagcgtgtttgttcgataccgaactcaaggcggcgcaggattacgacatttttctgcgcatggtggtggagtatggcgaaccgtggaaagttgaagaggcgacgcaaattttacatatcaaccacggcgagatgcagattacctcttcgccgaaaaagttctccggctatttccatttttatcgtaagcacaaagataaattcgatcgcgccagcaaaaaataccagctttttacgctgtaccaaattcgcaataagcgaatgacctggcgcacgttgctgacgttgctctccgtgcgtaatagcaaacgcctggcggccgggctgcgggggcgataacgatgctggaagacttacgcgcgaatagctggagcttacgcccctgttgcatggtgctggcctaccgtatcgctcatttttgttccgtctggcgcaaaaagaatgtgctgaataatctgtgggccgcgccggtgctggtgctgtatcgcgtgatcacggaatgcctgttcgggtatgaaatccaggccgccgcgaccattggtcggcggttcactatccatcatggttacgcggtagtgatcaacaaacatgtcgtcgccggcgacgattttaccattcgccacggcgtcaccattggcaatcgcggcgcggacagcctggcttgtccggtgattggtcacggcgttgagctgggggcgaacgtcatcctgcttggcgatattactatcggtaatcacgtcacgattggcgcgggtagcgtggtgcttgacagtattccggatcatgcgctggtggtgggagaaaaagcacgggtgaaggtcagcacatgaatattctgcaatttaatgtacggctggcggaaggcggtgcggcgggagtggcgttagatcttcatctgcgggcgctgcaaaaagggctgacgtcgcattttgtttatggttatggcaaaggcggaaaaaaaagcgtcagtcaccaccgttatccgcaggtgataaaacagacgccgcgcggcacggcaatcgccaatatcgcgctatttcgtttcctgaatcgcgatctgtttggcaatctcgacaatctttaccgcacggttatccagacatccggcccgctggtgctgcattttcatgttctccacagttactggctaaacctggcggatatcgtgacgttttgcgaaaaagtcaaagcacaaaaaccggacgtcacgctggtctggacgctgcacgatcactggagcgttaccgggcgttgcgccttcaccgacggttgcgagggctggaaaagcggctgccaaaaatgtccgaccctaagcaattatccgccagtcagggtggatcgggcgcaccagcttattgacggcaaacgtcagcgctttcgtgacatgctgcggctgggctgccagtttatttcgccgagccagcatgtggccgaggtctttaacagcgtttatggcgcgggactctgccgggtgattaacaacggtatcgatctggcgaccgaggcgattctcgcgcaactatcacctgtgccgctgaatccgggcaaaccgcggatcgccattgtggcgcatgacttgcgttacgacggcaaaactgaccagcgtctggtacacgacatgatggcgctgggcgaaaaaattgaactgcataccttcggtaaattttcgccttttaccggccaaaacgtcgttaatcacggttttgaaaccgataagcgcaaattaatgagcgcgctcaatgagatggacgcgctggtctttagctcgcgggtcgataactatccgctgatcttgtgtgaagcgctctcgatcggcgtaccggtaatcgccacccacagcgaggcggcgcaggaggtgctggcgaaatccggcggccagacttttgccgctacagatgtactgcgcctggcgcagcggcgtaagccagagattgctcaggcggtattcggcgcaacgctggacgcctttcgtatgcgtagccgcgtcgcgtacagcggtcaacagatgctggaggagtatgtctcgttctatcagaatctgtagctatctgctgctgccgctgatctacctactggtcaatgtcaagattgcccaactgggggaaagctttcccattaccatcgtcacttttttaccgctgttgctgctgttatttgtggaacgcattagcgtaaaaaaattgatgatcgccttaggcatcggcgcggggcttacggcatttaacttcctgttcggccagtcgctgaatgccggtaaatatgtcacgtccacgatgctgtttgtctatattgtggtcattatcgggatggtctggagtatccgattcaaaaccatttccgcgcataaccaccgaaagattttgcgtttttttatctggtggtgggtatagtggtcgcgctcgccgcggttgagatggcgcaaattatccttaccggcggcagcagtatcatggaaggaatttcgaaatatctcatttacagtaatagctacgtactgaacttcataaaatttggcggtaagcgtaccactgcgctttattttgaaccggcatttttcgctttggcactaatctcaatttggctgagcatcaaacagtttggtatcaaaataccgaaaagcgatgctatgattctggcagggataatattatcaggatcattttcaggggtaatgacctttatcctgttttaccttctggagtgggcgttccaatatttgaataaggatgcgataaagaaaaaacttccactggcgctggtatcattaaccctgtttttggttggggtaattattgcatttccttatatcgcgacacgacttggcgatttagggacggaaggattatcttcttattatcgtattgtgggcccgttagtcatggtcggatattccttgacccatattgatggtgtagtcagatttggctcactttatgaatatgtcgcatcattcggaatctttaacggtgcggatgtcgggaaaaccatagacaatggattgtatctgctgattatttatttttcctggttcgcagtgctaatgacgctgtggtatatggggaaagttttaaaaatggcgctaaatgcgtttggcgataatcgcaattttcgggtgcagctctatctttttacgccggtgtcgctgttttttaccggttcaatatttagcccggaatatgcttttttaatcgtctgtccgttcattttgcgcaaggcgttaaaaatttcataacggggtggttgcatgtttttaagcgtcgttaccgtcgcctttcgcaattacgaaggggtggtaaaaacctggcgctcgctgcgcaatctggcgcgcgatccgggcctgtcatttgaatggatcgtagtggatggcggttcggaggacggcacgcgcgaatttctgcaaaaacgtcacggtgagtttaacctgcgttttatcagtgaaaaggatcgcggtatttatgatgccatgaacaaaggcattgccttggcgcaggggcgctataccctgtttcttaattccggtgatgcgttccatgatgatgccgcgctgtttgtccgccaactggcgcggcaaaagggcgaggcgatgtatattggcgacgcgctgctggatttcggcggcgggcataaaatacgccggaaagctaaacccgggtattatatctaccatagtttgccagccagccatcaggcgatatttttcccgacggcagcgttaaaaaagtatccttatgatctgcaatatcatgtctcttcagattatgcgctggcggcccgtctctataaagcaggctatccttttcggcgaattaacggactggtatctgaattttcgatgggcggcgtgtcaacctcgaataatctggaattatgtcaggatgcaaaaaacgtacagcgaaaaatattacgtgttccagggttttgggcgcaattatcctatttgttacgtctgaaaacgacgggtaaaacaaaagcgcggtataacaaagtctaatcaccgggagttattatgcaggatcttagcggctttacggtgccgaaagggttccgcggcgctaatgcgctaaaagtacaattatggtgggcggtacaggcgacattattcgccggatcgccgcaaatattgtatcgctggcgagcctttttgctgcgtctgtttggcgccaaaattggaaaaaatgtggttattcgaccgtcagtaaaaattacctatccgtggaaattaaccgtcggcgattatgcctggataggcgacgacgctgtgttatatacgttgggtgaaattaatattggcgcacatgcggttatttcacaaaaaggttatttatgtaccggtagccatgattataccagcgcccatttcgatattaacgccgcgccgattgttattggcgaaaaatgttggctggcgaccgatgtttttgtcgcgcccggcgtgacgataggtcatggcaccgtcgtcggcgcgcgtagcagcgtatttaaatcattaccggcaaatgcgatttgtcggggcaatcccgcagtggtaacgcgccagcgcgttcagaaagttactccctaacgggactatttgaggaaatgaaaatgtcaaaagtcgctctcattactggcgtaaccggacaggatgggtcttacctggcagaatttctgctggaaaaagggtatgaggtgcatggtatcaagcgtcgcgcgtcatcgtttaataccgagcgcgtggaccatatttatcaggacccgcacagctgcaacccgaaatttcatctgcattatggcgacctgaccgacgcctcaaacctgacccgcattttacaagaagtgcagccggatgaggtctacaacctgggcgcgatgagccacgtggcggtgtcgtttgagtcgccggaatataccgccgatgtggatgcgatgggcactctgcgcctgctggaggcgatccgcttcctcggtcttgaaaagaaaacgcgtttctaccaggcctccacctctgaactgtacgggctggtgcaggaaatcccgcagaaagagaccacgccgttctacccgcgttctccctatgcggtggcgaaactgtacgcctactggatcaccgtcaactaccgtgaatcctacggtatttacgcctgtaacggcattctgtttaaccacgagtctccgcgtcgtggcgaaaccttcgtcacccgtaagatcacccgcgccatcgccaatatcgcccagggactggagtcctgcctgtatctcggcaacatggactcgctgcgcgactggggccatgcgaaagattacgtacggatgcagtggatgatgttacagcaggagcagccggaagatttcgtgattgccaccggcgtgcagtattccgtacgccagtttgtggagctggcggcggcgcaactggggataaaactgcgctttgaaggcgaaggcattaatgagaaagggatcgtggtatccgttaccggacacgatgcgccgggcgtgaaaccgagggatgtgattgtggccgttgatccgtgttatttccgtccggcggaagtggaaaccctgctgggcgatccgtccaaagcgcatgagaaactgggctggaaaccggaaattaccctgtcggagatggtctccgagatggtggcgaacgatctggaggccgcgaaaaaacactcactgctgaaatctcacggttacgaggtggccatcgcgctggagtcctgagaatgaataagcaacgaatttttgtggcgggccatcgcgggatggtgggctccgccattgtacggcagcttgcgcagcgcggcgacgtggaactggtgctgcgcacccgcgatgagctggatctgctcgacgggcgcgcggtacaggcgttctttgccggagcgggtatcgaccaggtttatctggcggcggcgaaagtgggcggcattgttgccaacaacacgtatccggcggattttatttatgaaaacatgatgatagagagcaacattattcacgccgcgcacctgcacaacgtgaacaaactgctgtttctcggttcgtcctgtatctatccgaaactggcaaggcagccgatggcggaaagcgagctgctgcaggggacgctggagccgaccaacgagccgtatgccatcgccaagatcgccgggattaaactgtgcgagtcctacaaccggcagtacggtcgcgactaccgttcggtgatgccaaccaacctgtacggcccgcatgataatttccacccggacaattcacatgtgatcccggcgctgctgcgtcgctttcatgaggctgcgcagagccacgcgccggaggtggtggtgtggggcaacggcacgccgatgcgcgaatttctgcacgttgacgatatggcggcggccagcattcacgtgatggagctggcgcgcgaagtgtggcaggagaacaccgccccgatgctgtcgcacattaacgtcggcactggcgtggactgcaccattcgcgagctggcgcagaccatcgcaaaggtggtgggttaccagggccgggtggtgttcgacgccgcgaagccggacggcacgccgcgtaaattgctcgacgtcacgcgcctgcatcagcttggctggtatcacgaaatttcactggaggcagggcttgccggtacttaccagtggttccttgagaatcagcaacggttccgggggtgacaatgtttttacgtcaggaagatttcgccgccgtggtgcggaccacgcccctcatctccctcgatttcatcgtggaaaacggccagggggaaattttgctgggccagcgcctcaaccgtccggcgcagggctactggtttgtgccgggggggcgggtgtgcaaagacgaaacgctggaggccgcttttgcacgcctgacgcaggcggaactgggcgtgcgtctgccgctggcggcagggacgttttatggcgtctggcagcacttctatgacgacaacttttccagtgaggatttttcaactcactacatcgtgctcggctttcgtctgcgcgtggcggagagcgatttacgcctgcctgatgcccagcatggcagttaccgctggctgacgccggaacagcttctggcaggcgacaatgttcatgagaacagtcgggcctacttctctcctgacgcgccggcggtgggcctatgaagatcctggtctatggcattaactattcaccggaactgaccggtatcggcaaatataccggcgaaatggtggcgtggatggcgcgggaaggccatgaggtgcgggttattactgcgccgccgtactacccgcagtggaaggtcggtgagcgctattccgcctggcgctatcgccgggaagagggcgaggctaccgtctggcgctgcccgctgtatgtgccgaaacagccctccaccctaaaacgactgcttcatctggggagctttgcattgagcagttttttcccactgatggcgcagcgtcgctggaagccggatcggattatcggcgttgtaccgacgctcttttgtacgccgggaatgcgtctgctggcgacactctccggcgcgcgtaccgtactgcatattcaggattacgaagtggacgccatgctcggcttaggaatggcgggaaaaggcaagcgcggcagcgtagcgcggttagcgacggcctttgaacgcagcgcgctgcgtaacgttgataatgtttcgaccatctctcgctccatgatgaataaagcgcgggaaaagggcgtcgcggcggaaaaaatcctcttttttccaaactggtcggaagtggcgcgctttcaggacgttaatgacgctgacgtgacggctttgcgtcagcagcttggcttgccagagggcaaaaaaatcgtgctctattccggcaatatcggcgaaaaacaagggctggaaaaggtgattgacgccgcagaacgattacgcgatcgaccgttgatttttgcgattgtcggccaggggggcggcaaggcgcggctggagaacatggcccgcgaacgcggcctgctaaatattaaattcctcccgctgcagccttacgacgccttacccgcgctgctgaaaatgggcgactgccatctggtggtgcaaaagcgcggcgcagcggatgcggtactgccctccaagctgactaacattctggcggtcggcggtaatgcggtgattaccgctgagccgcacaccgaattaggacaactttgcgcgcgctatccgggcatcgccgtttgcgtggagccggagtcgaccgacgcgctggtcgacgggattagccaggcgctcgccatgccgaaaaacaacacgacggcacgtgaatacgccgaacgcacgctcaataaagagaacgtgctacgccaatttattgcagatattcggggatgataatgcgtcagacaaaactttacccggttgtgatggccggtggctccggtagccgattgtggccgctttctcgcgtgctttatccaaaacagtttttgtgcctgaaaggcgatctcaccatgttgcaaaccaccatttgccgtctgaacggcgtggagtgcgaaagcccggtggttatctgcaacgaacagcaccgttttatcgtcgccgaacagctccgccagctcaataagctgacggagaacattattcttgagcccgccgggcgcaataccgcgccggcgattgcgttggcggcgctggcagcgacgcgccagcatacggactgcgatccgctgatgctggtactggcggcggatcatgcgatcgccaatgaagaggccttccgcgacgcggtgcgcggcgccatgccctatgccgacgcgggcaaactggtgaccttcggtatcgtgccggatctgccggaaaccggctatggctatatccggcgcggtgatgtcgtgccgggcgcgacggatgcggtggcttttgaggtggcgcagttcgttgagaagccggggctggaaaccgcccaggcctacgtcgccagcggcgattactactggaacagcggcatgtttctattccgcgccggacgctatctggaagagctgaaaaagttccgccccgatattctggccgcctgtgaacaggcgatgcgcggcgtcgatccggatcttgacttcattcgcgtggatgaagaggccttcctcgcctgtccggaagagtccattgactacgcggtgatggagcggacggcggacgcggtggtgatgccaatggacgcgggctggagcgatgtcggctcgtggtcctcactgtgggaaatcagcgcccacaccccggagggaaacgtccaccacggcgacgtcatcagtcataaaacggaaaacagctacgtttacgccgaatccggcctggtgaccaccgtcggcgtgaaggatctggtggtggtgcagaccaaagacgccgtgctgattgccgatcgccacgcggtgcaggacgtgaaaaaggtggtggagaagatcaaggccgacggacgccatgagcaccacatgcaccgcgaggtttaccgtccgtggggcaaatacgactccatcgacgcgggcgagcgctatcaggtgaagcgcattaccgttaagccgggggaaggactgtcggtgcagatgcaccatcaccgtgccgagcactgggtggtggtggcggggaccgccagagtcaccatcaacggcgaggttaagctgctcggtgaaaacgagtccatctatattccgctgggggcgacccactgcctggaaaatccgggaaaaataccgctcgatttaattgaagtgcgttccggctcgtatctcgaagaggacgacgtggtgcggttcgaggaccgttacgggcgggtctgacgcctgcaattatgcccggtaagcgcaacgcgccatccggcaatgaataacaataacgatgttggccatttgcggtcagggctaactgttgcctgaagaagggtaagcacatgacaaaattaacctgtttcaaggcctacgacattcgcggcaggctgggcgaagagctcaatgaagatatcgcgtggcggattggccgcgcctatggcgaatatttaaaaccgaaaaccatcgtgctgggcggcgacgtgcgcctgaccagcgaggtgctgaagatggcgctggcaaaagggttacaggacgcgggcgtcgacgtgctggatatcggtatgtccggcaccgaagagatttacttcgccaccttccacctcggcgtggacggcggtattgaagtgaccgccagccataacccgatggactacaacggtatgaagctggtgcgcgagggcgcccgcccgataagcggcgacaccggtctgcgcgacgttcagcgcctggcggaagcgggcgacttcccgccggtcaacgacgccacgcgcggcagctacagacaaatcagcatgcgcgacgcctacatcgaccacctgctcggctacatcagtgttaacaatctcaccccgctgaagctggtgtttaacgccggcaacggcgcggcggggccggtcattgacgccattgaagcgcgcctgaaggcgctgggcgcgccggtggagttcatcaaaatccacaacaccccggacggcaccttcccgaaaggcattcccaacccgttgctgccggagtgtcgcgacgacacccgcaaggccgttattgaacacggggcggacatgggcatcgcctttgacggcgacttcgaccgctgcttcctgttcgatgagaaagggaagtttatcgaggggtactacatcgtcgggctgctggcggaagcgtttctggaaaaacacccgggggcgaagattatccacgacccgcgcctgacctggaacaccgaggcagtggtgacggcggcgggcgggacgccgatgatgtcaaaaaccgggcacgcctttatcaaggagcggatgcgtacggaggatgccatttatggcggggaaatgagcgcgcatcactatttccgtgattttgcctactgcgacagcgggatgatcccgtggctgctggtggcggaactggtatgcctgaaggggcagtcgctgggtgaactggttcgcgaccggatggcggcgttcccggcgagcggggaaatcaacagcagactggcggagccggcggcggccatcgcgcgggtggaagcgcacttcgcggaagaggcgcaggcagtggaccgcacggacggcctcagcatgtcgttcgccgactggcgtttcaacctgcgctcgtcgaacaccgaaccggtggtgcgcctgaatgtggaatcacgcggcgatattccgctgatggaagcgcgaacacgcactctgctggcgctgctgaatcagtaacgtcagatctccccttaccgcctgcgggtaaggggccaatcacaggaacaacgatgacaaatctaaaaaagcgcgaacgagccaaaaccaatgcatcgttaatctctatggtgcaacgcttttcagatatcaccatcatgtttggcgggctgtggttcatctgtgaagtcagtggactgccattcctgtacatgcacctgttggtggcgctgattacgctggttgtttttcaaatgctgggcgggatgaccgatttttatcgctcctggcgcggcgtcaaaatgtcgacagagttaacgctgttactgcaaaactggacgctgagcctgatcttcagcgccggtctggtggcgtttaatgatgactttgacaaccgcctcgccacctggttggcctggtatgcgctgtccagcctgggcttagtgttatgccgttcatttattcgtttcggcgcgggctggctacgcaatcgtggttataacactcgccggggcgccgtcgccggggatttgcctgcgggccaggcgttgctggatagcttccgtaatgagccgtggctgggttttgaggtggtgggcgtctatcacgatcctaaaccgggcggcgtctctgctgactgggccgggaacttcgaacagttaattgacgatgcgaaagcctcgcgaattcacaatgtttatatcgccatgtcaatgagcgacggcgccatggtgaaaaaactggtgcgcgagctggccgacaccacctgctcggtgatccttattcccgatgtgttcacctttaatattctccactcgcgcgtggaggagatgagcggcgttccggtcgttccgctgtatgacacgccgctatcagggattaaccgtctgcttaaacgggcagaagatatcgtgctggcgtcgctgattctgctgctcatctcaccggtactgtgctgcattgcgccggcggtcaaattgagctcgcccgggccggtgattttccgtcagacgcgctacgggatggacggcaagccgagcaaagtctggaggttccgctcaatgaaggtgatggagaacgataaggtcgttacccaggcgacgcaaaacgatccgcgcgtcacccgggtaggtaactttttgcgtcgtacctcgctggatgaattaccgcagtttatcaacgtattaaccggcgggatgtctatcgtcggtcctcgcccgcacgcggtggcgcataacgaacagtatcgtcagttgattgaaggttacatgctacgccacaagatgaagccgggcatcaccggctgggcgcaaattaatggctggcgcggtgagaccgatacgctggagaaaatggaaaaacgcgtggaattcgacctggaatacatccgcgaatggagtatttggttcgatatcaaaatcgtttttctgacgatttttaaagggtttgttaataaagcggcgtattaagaacctgacccacaaggctattttacttgccatattgcaccagggcagtgctcaatctggctgcgccaatgacgccttgtgaacaggttctggagaaaagaatgagtttacgacaaaaaacgatcagcggcgttaaatggtcggctatcgccacgatagtgattatcggtctggggttaattcagatgacggtgctggcgcggatcatcgacaaccaccagtttggcctgttgaccgtatcgctggtgattatcgcgctggccgacacgatttcggactttggcatcgcgaactcgattatccagcgtaaaacgattgggcatctggagctgaccacgctttactggctaaacgttgggcttgggattgtggtatttgcggtggtcttttggctgagcgatgcgattgcccatgttttgcataacccggatctcgcgccgttaatcaaaacgttgtcgctggcgttcatcgtgatccctcacgggcagcagttccgcgcgctgatgcaaaaagagctggagttcaataagatcggcatgatcgaaacgacctccgtgctggcggggttcacctttacggtgattagcgcccattactggccgctggcgttaaccgcgattctcggctatctggtgaacagcgcggtgcgaacgctgctgtttggttactttggccgcaagatttaccgtccggggctgcatttttcgctggcatcggtgtccacgaacctgcgttttggcgcgtggctgacggcggacagtatcgtcaattacatcaacacgaatttatcgacgctggtactggcgagaattctcggcgcaagcgtcgccgggggatataacctcgcgtacaacgtggctgttgtgccgccggcgaagcttaaccccatcattactcgcgtgctatttccggcattcgccaaaatccaggacgataccgagaagctgcgcgtcaacttctataagttgctttccgtggtgggaattatcaattttcccgcgctgttgggcctgatggtagtggcgaacaattttgtgccgttagtgtttggtgagaagtggaacagcattatcccgatcctgaaattgctgtgcgttgtggggctgctgcgctcagtcggcaacccgattggttcgctgctgatggcgaaagcgcgcgtggatatcagctttaagttcaacgtctttaaaacgtttctgtttatcccggcaattctcattggcggccatctggcgggggcgattggcgtgacgctggggttcctggtggtgcaaatcatcaacaccattctgagctatttcgtgatgattaagccggtactcggctccagctaccgtcagtatattctcagcctgtggctaccgttttatctctcattgcccacatttattaccagctacggcgcaggaaagctagtcgacggctatttaccgttgtcaggggtattcgcgctacaggttgtggtcggtattttgagttttattttaatgattattttttcacgcaatgcgctggtgatggaaattaaaaatcagcttgttggcagtgaaaaaatgaaaaagttattacgtgtcggatgacgaggatataagaggctatttatgaaattattaattttaggcaaccacacatgcggcaaccgtggtgatagcgccattatgcgcggtttgcttgatgccatccgtcaacaggcgccagaggcggagatggatgtgatgagccgtttcccggtgagttcctcctggttgcaggggcgaccgattattgccgacccgctgtatcaattaagccagaaacagcaggcggcggcagggcttaacggtcgggtgaaaaagtattacgccgtcgttttcagcataaaattttattgtctaaagtcgcccaggaaggatcgctgcgtaattttgctatcgcgccggaatttgccgaattcgcgcaatttattgcgcagtatgacgccgtcattcaggtgggcggttcaaactatgtcgacttatacggtttgactcactttgaatatccgctgtgcgcgtttatggcgaacaaaccaatttatatggtgggacatagcgtcggccctttccagaaccctgactttaactagctcgccaattatgttttgggcgcaccagtgcgctgatcctgcgtgaaaccgtcagccgcgatctgatgaccgccgcgcagatcgatacccgaaaagtagagcagggggtggataccgcctggttagtcgaacgccgtcacgacgagtttgtcgccagttatgctgtgcagcactggctggacgtcaccgcgcgccgcaaaaccgtcgcgattacgttgcgcgatctggagccgtttgataaacgcctgggcaccactcagcaggcctatgagcaggcatttgcccaggtcgtgaatcgcctgattgcggacggttatcaggtactggcgctgtcgacctgcaccagtatcgatcgctataaccgcgatgaccggatggttgcgttacggatggcgaagtatgtaaacgactcagagcatttccatatcgcgatggacgaactcaatgacgtggaaatcggaaagatcctcgcatcctgcgtactgaccatcgggacgcgcctgcattccgccattatctccatgaattttggcacgcccgctatcgccattaattatgaacataaatccgccgggattatgcagcagctaggcctggcggaattggccatcgatatccgtcacttgctgaacggttcattacaaagcgtggtggccgatacgctcaatcaattgcctgcgctaaaggcaaaagtggctaacgccgtcaccgaggagcgggcgaaagggttcacgatgatcaaatctgctctcgacagaattcgggaggcgcaatgaaagtcagcttttttctgctgaaatttccactctcatcggaaacctttgtgctgaatcagattactgcgtttattgatatgggccatgaggtggagattgtcgcgttacaaaaaggcgatacccaacatactcacgccgcctgggagaagtatggcctggcggcgaaaacccgctggttacaggatgagccccagggacggctggcgaagctgcgctaccgggcatgtaaaacgctgccggggctgcatcgggcggcgacctggaaagcgctcaattttacccgctacggcgatgaatcacgcaatttgatcctttccgcgatttgcgcgcaggcgggccaaccttttgtggcggatgtgttcatcgcgcactttggtccggcgggcgtgacggcggccaaactgcgcgaactgggcgtgcttcgcggcaaaatcgagactattttccacggaattgatatttccagtcgcgaggtgctcagtcattacacgccggagtatcagcagttgtttcgtcgtggcgatctgatgctgcccatcagcgatctgtgggccggtcgcctgaaaagtatgggctgtccgccggaaaagattgccgtttcgcgcatgggcgtcgacatgacgcgtttttcccatcgtccggtgaaagcgccagggatgccgctggagatgatttccgtcgcgcgcctgaccgagaaaaaaggcctgcatgtggcgattgaagcctgtcggcaactgaaagcgcagggcgtggcgtttcgctaccgcattctggggattggcccgtgggaacgtcggctgcgcacgctcattgagcagtatcagttagaggatgtcattgagatgccgggttttaaaccgagccatgaagtgaaggcgatgctggatgacgccgatgtttttttgctgccgtcgattaccggtacggatggcgatatggaaggtattccggtagcgctgatggagacgatggcggtggggattcccgtggtgtctaccgtgcatagcggtattccggaactggtggaggccggcaaatccggctggctggtaccggaaaacgatgcgcaggcgctggcggcccgactcgctgagttcagccggattgaccacgatacgctggggtcggtgatcatgcgcgctcgtgaaaaagtggcgcaagattttaatcagcaggcgattaatcgccagttagccagcctgctacaaaccatataaacgaggtggtatgcccgcgactaaattctcccgacgtaccctcctgacggcaggttccgcgcttgctgttcttccttttctgcgcgccttgccggtacaggcgcgtgaacctcgccagaccgtcgatattaaggattatccggcggatgacggtatcgcctcgttcaaacaggccttcgccgacgggcagactgtggtcgtgccgtcaggatgggtgtgtgaaaatatcaatgcggcgataacgattccggcgggaaaaacgctgcggatacagggcgcggtgcgtgggaatggccggggacggtttattttgctggacgggtgtcaggtggtgggggagcagggcggcagtctgcacaatgtgacgctggatgttcgcgggtcggactgtgtgattaaaggcgtgacgatgagcggctttggccccgtcgcgcaaattttcatcggcggtaaggaaccgcaggtgatgcgtaatctcattatcgatgacatcaccgttacccacgccaactacgccattctccgccagggatttcataaccaaatggacggcgcgcggattacgcatagtcgctttagcgatttgcagggggacgccattgagtggaatgtcgcgattcatgaccgcgacatcctgatttccgatcatgtcatcgaacgcattgattgtaccaatggcaaaatcaactgggggatcggcatcgggctggcgggtagcgcctatgacaatagttatcctgaagaccaggcagtaaaaaactttgtggtggccaatattaccggatctgattgccgacaactggtacacgtagaaaatggcaaacatttcgtcattcgcaatgtcaaagccaaaaacatcacgcccgatttcagtaaaaatgcgggtattgataacgcaacgatcgccatttatggctgtgataatttcgtcattgataatattgatatgacgaatagtgccgggatgctcatcggctatggcgtcgttaaaggaaaatacctgtcaattccgcaaaactttaaattaaacgctattcggttggataatcgccaggttgcttataaattacgcggcattcaaatttcctccggtaacgccccctcatttgttgccatcaccaatgtacggatgacgcgtgctacgctggaactgcataatcaaccgcagcacctctttttgcgtaatatcaacgtgatgcaaacttcagcgattggcccggcgttaaaaatgcattttgatttgcgtaaagatgtccgtggtcaatttatggcccgccaggacacgctgctttccctcgctaatgttcatgccatcaatgaaaacgggcagagttccgtggatatcgacaggattaatcaccaaaccgtgaatgtcgaagcagtgaatttttcgctgccgaagcggggagggtaagtaccgctatttttacgaaaattcctgggaaaaagttgttcatacttaatgttatggtgccgactaagacgtaatgtagagcgtgccatcattatccctggcagcagagtaattcatgctggcgaaaacaagctaaagagctataattcagcaaccattttacaggtggaagaaacaatgatgaatttgaaagcagttataccggtagcgggtttgggtatgcatatgttgcctgccaccaaggcaatcccaaaagagatgctaccgatcgtcgacaaaccgatgattcagtacattgtcgatgagattgtggctgcagggatcaaagaaatcgtgctggtgactcacgcgtctaaaaatgccgttgagaaccacttcgacacctcttatgaacttgaatcgcttcttgagcagcgcgttaagcgtcagcttctggcggaagtgcaatctatctgcccaccgggcgtgacgattatgaacgttcgccaggcgcagccgttaggactggggcactctattctgtgcgcgcgtccggttgtgggcgataaccctttcattgtggtactcccggatattattattgatgatgctaccgccgatccgctgcgctataaccttgcggcgatggtggcgcgtttcaatgaaacgggtcgcagccaggtgctggcaaagcgcatgaaaggtgatttatcggagtattccgttatccagacgaaagaacctctggataatgaaggcaaagtcagccggattgtggagtttatcgaaaaaccggatcagccgcagacgctggattccgatttgatggcggtaggccgttatgtgctttcagccgacatctgggcggaactggaaagaaccgaaccgggcgcctggggccgcatccagcttaccgatgcgattgctgaactggcgaaaaaacagtcggttgacgcgatgctaatgacgggcgacagctatgactgcggtaaaaaaatgggctacatgcaggcatttgtgaagtacgggctgcgcaacctgaaagaaggagcgaagttccgtaagagcatagagcagcttctgcatgaataagtattaacaaccgtgataaatggttggtgataaacataataacggcagtgaacattcgaagcggcaagttggctgaaacgagtgttgactgccgttttagttttgtataaagggcttaagtaacaaggggttatctggagcattttaatgctgattttataagattaatccttgtttccggatgcaattaataagacaattagcgtttaagttttagtgagctttgccctgctgggcgaggtttgtaacaagtcgatatgtacgcagtgcactggtagctgatgaaccaggggcggtagcgtgtgtaacgacttgagcaattaatttttattggcaaattaaataccacattaaatacgccttatggaatagaaaagtgaagatacttattactggcggggcaggttttattggatcagctgttgttcgccatattattaagaatacacaggacactgtagttaatattgataaattaacctacgccggtaatcttgaatccctttctgatatttctgaaagtaatcgctacaattttgaacacgcggatatttgtgattccgctgaaataacgcgtatttttgagcagtaccagccggacgcggtgatgcatttggctgcggaaagtcatgtggaccgttcgattaccgggccggcagcatttattgaaaccaatatcgtcggcacctatgtacttcttgaagttgcgcgtaaatactggtctgcgcttggcgaagataaaaaaaataattttcgttttcatcatatttccactgatgaagtttacggcgatttaccacatcctgatgaagttgaaaacagcgttacgttgccgttatttactgaaacgacggcatatgcgccaagtagcccctattctgcgtcaaaagcatccagcgatcatttagtccgtgcctggcggcgtacctatggtctaccaacgatcgttaccaattgttctaataactatggcccttatcacttccctgaaaaactgattccgttggtcattttgaacgcactggaaggaaagcctttgccaatttatggcaaaggggatcagattcgcgattggctatatgtagaagatcacgctcgcgcgcttcatatggtagtgactgaaggcaaggcaggggagacttataacattggtggccacaatgagaagaaaaatctcgatgtggtatttaccatctgtgatctgctggatgagattgtacccaaagcgacttcttatcgtgaacaaatcacttatgtcgcggatcgtccgggccatgatcgtcgttatgccattgatgcaggtaaaattagccgtgaattaggctggaaaccgctggagacctttgaaagcggtattcgtaaaacagtggaatggtaccttgcaaatactcaatgggtaaacaatgttaaaagtggggcgtatcagagttggatagaacagaactatgaaggacgccagtaatgaatatcttactttttggtaagacagggcaagtaggctgggagttgcaacgttctctggcgccagtggggaatctgattgccctggatgtccattcaaaagagttttgcggtgattttagtaatccgaaaggcgttgccgaaaccgttcgtaagcttcgtcccgatgtgattgttaacgcagcagcacatactgcagtagataaagcagagtctgaaccagaactggcgcagttgcttaacgccaccagtgtggaagccatcgctaaagcggccaacgaaattggcgcatgggtagtgcattattcaaccgattatgtatttcctggtaccggcgatatcccatggcaggaaacggacgctacgtcgccgctgaatgtctatggcaagaccaaactagcgggagaaaaggccctgcaggataactgccctaaatacctaatcttccgcaccagttgggtttatgcaggtaagggcaataatttcgcaaagacaatgcttcgtctggcgaaagagcgtcagacactttcagtcatcaacgatcagtacggtgcgccaaccggtgcggaattactggctgactgcacggctcatgcgatccgtgtgacattaaataaaccagaagtcgcaggtctttaccatctggttgccgggggaactacaacctggcatgactacgcggcgttagtctttgacgaggcgcgcaaagcagggataacgcttgcgctgactgagcttaatgctgtgccgaccagcgcctacccgacgccggcgagcagacctggtaattcgcgtctcaatactgaaaagtttcagcgtaattttggccttattctgccgcaatgggaattaggagttaagcgtatgctgactgaaatgtttacgacgacaaccatctgataaatttaaatgcccataagggcattttctatgaatgagaaatggaaatgaaaacgcgtaagggcattattttagcgggaggctccggcactcgtctttatccggtgaccatggcggtaagtaagcaattgctaccaatttatgataaaccgatgatttactatcccctttccacacttatgctggcaggcattcgggatatcctgatcatcagtacgccacaggacacgccgcgttttcaacaactgctgggagacggcagccaatgggggctgaatcttcaatataaagtacagccaagtccggatggcttagcacaggcgtttattattggtgaagagttcattggtaataatgattgtgcattagtgctgggtgacaatatcttctatggtcatgatttaccaaagttaatggaagctgccgttaataaagaaagtggtgctaccgtcttcgcttatcatgtaaacgatccagagcgctacggtgtggttgagtttgaccaaaatggcacagccgttagtctggaggaaaaaccgttacaaccgaagagtaattacgcggtaacggggctgtatttttatgataatagcgtggtggagatggcgaaaaatcttaagccttcctctcgcggtgagttagaaatcacggatattaaccgtatctatatggatcagggaagattgtctgtcgctatgatggggcgcggttatgcctggctggatacgggaacgcatcagagtttgatagaggccagtaattttattgcaaccatcgaagaacgccagggtctgaaagtgtcttgcccggaagagatcgcatttcgtaaaaattttataaatgcacaacaggttataaaactggccgggccattatcaaaaaatgattacggcaaatatttgctgaagatggtgaaaggtttataagtgatgattgtgattaaaacagcaataccagatgtcttgatcttagagcctaaagtttttggcgatgagaggggattcttttttgaaagttataaccagcagacctttgaagagtcgattggacgtaaagttacatttgttcaagataatcattcaaaatccaaaaagaatgtactcagagggctacattttcagagaggagaaaatgcacagggaaagttagttcgctgtgctgtcggtgaggtttttgatgttgcggtcgatatccgaaaagaatcacctacttttggtcagtgggttggcgtaaatctatctgctgagaataagcgacagctttggattccagaaggttttgctcatggttttgttactctcagtgattatgcagagtttctgtacaaagcaactaattattactcaccttcatcggaaggtagcattctatggaatgatgagacaataggtattgaatggcctttttctcagctgcctgagctttcagcaaaagatgctgcagcacctttactgcatcaagccttgttaacagagtaagcatcgtgtctcatattattaagatttttccatcaaatattgaattttccggtagagaggatgaatcaatcctcgatgctgcgctatcggctggcatccatcttgaacatagctgcaaagcgggtgattgtggtatctgtgagtccgatttgttagcgggagaagttgttgactccaaaggtaatatttttggacagggtgataaaatactaacctgctgctgtaaacctaaaaccgcccttgagctaaatgcgcatttttttcctgaactagctggacagacaaaaaaaattgtcccatgcaaggtaaatagtgctgtactggtttcaggcgatgttatgactttgaagttacgcacaccaccaacagcaaaaattggcttctttccagggcagtatatcaatttacattataaaggtgtaactcgcagttattctatcgctaatagtgatgagtcgaatggtattgagttgcatgtaaggaatgttcccaatggtcagatgagctcgctcatttttggggagttacaagaaaatactcttatgcgcattgaaggaccttgcggaacattttttattcgtgaaagtgacagacctataatcttccttgcaggcggtactggattcgctccagttaaatcaatggttgagcatctcattcagggaaaatgtcgtcgtgagatctacatctactggggaatgcaagatagtaaagatttttactctgcattaccgcagcagtggagtgaacagcacgacaacgttcattatatccctgttgtttctggtgatgacgccgaatgggggggaagaaagggatttgtccatcatgctgtgatggatgattttgattctctagagttcttcgatatatatgcatgtggttcacctgtgatgatcgatgccagtaaaaaggactttatgatgaaaaatctctctgtagaacatttctattctgatgcatttaccgcatctaaataatattgaggataatttatgaaagcggtcatcctggctggtggacttggtaccagattaagtgaagaaacaattgtaaaaccaaaaccgatggtagaaattggtggcaagcctattctttggcacattatgaaaatgtattctgtgcatggtatcaaggattttattatctgctgtggttataaaggatatgtgattaaagaatattttgcgaactacttccttcacatgtcagatgtaacattccatatggctgaaaaccgtatggaagttcaccataaacgtgttgaaccatggaatgtcacattggttgatacgggtgattcttcaatgactggtggtcgtctgaaacgtgttgctgaatacgtaaaagatgacgaggctttcctgtttacttatggtgatggcgttgccgaccttgatatcaaagcgactatcgatttccataaggctcacggtaagaaagcgaccttaacagctacttttccaccaggacgctttggcgcattagatatccaagctggtcaggtccggtcattccaggaaaagccgaaaggcgatggggcaatgatcaatggtggtttctttgtgttgaatccatcggttatcgatctcatcgataacgatgcaacaacctgggaacaagagccattaatgacattggcacaacagggggagttaatggcttttgaacacccaggtttctggcagccgatggataccctacgtgataaagtttacctcgaagggctgtgggaaaaaggtaaagctccgtggaaaacctgggagtaagtagatgattgataaaaatttttggcaaggtaaacgtgtattcgttaccggccatactggctttaaaggaagctggctttcgctatggctgactgaaatgggtgcaattgtaaaaggctatgcacttgatgcgccaactgttccaagtttatttgagatagtgcgtcttaatgatcttatggaatctcatattggcgacattcgtgattttgaaaagctgcgcagttctattgcagaatttaagccagaaattgttttccatatggcagcccagcctttagtgcgcctatcttatgaacagccaatcgaaacatactcaacaaatgttatgggtactgtccatctgcttgaagcagttaagcaagtaggtaacataaaggcagtcgtaaatatcaccagtgataagtgctacgacaatcgtgagtgggtgtggggctatcgtgagaacgaacccatgggagggtacgatccatactctaatagtaaaggttgtgcagaattagtcgcgtctgcattccggaactcattcttcaatcctgcaaattatgagcaacatggcgttggtttggcgtctgtgagggctggtaatgtcataggtggaggcgattgggctaaagaccgtttaattcccgatattctgcgctcatttgaaaataaccagcaggttattattcgaaacccatattctatccgtccctggcagcatgtactggagcctctttctggttacattgtggtggcgcaacgcttgtatacagaaggtgctaagttttctgaaggatggaatttcggcccgcgtgatgaagatgcgaagacggtcgaatttattgttgacaagatggttacgctttggggtgatgatgcaagctggttactggatggtgagaatcatcctcatgaggcacattacctgaaactggattgctctaaagcaaatatgcaattaggatggcatccgcgttggggattgactgaaacacttagtcgcatcgtaaaatggcataaagcatggattcgcggcgaagatatgttgatttgttcaaagcgtgaaatcagcgactatatgtctgcaactactcgttaagaaaataagtttaaggaatcaaagtaatgacagcaaataacctgcgtgagcaaatctctcagcttgtcgctcagtatgcgaatgaggcattgagcccgaaaccttttgttgcaggtgcaagcgttgtacctccttccgggaaggttattggtgccaaagagttacaattgatggttgaggcgtctcttgatggatggctaactactggtcgtttcaatgatgcctttgagaaaaaacttggggaatttattggagttcctcatgttttaacgactacatctggctcttcggcaaacttgctggcactgactgcgctgacttccccaaaattaggcgagcgtgctctcaaacctggtgatgaggttattactgtcgctgctggcttcccgactacagttaacccggcgatccagaatggtttaataccggtattcgtggatgttgatatcccgacatataatatcgatgcctctctcattgaagctgcagttactgagaaatcaaaagcgataatgatcgctcatacactcggtaatgcatttaacctgagtgaagttcgtcggattgccgataaatataacttatggttgattgaagactgctgtgatgcccttgggacgacttatgaaggccggatggtaggtacctttggtgacatcggaaccgttagtttttatccggctcaccatatcacaatgggtgaaggcggtgctgtattcaccaagtcaggtgaactgaagaaaattattgagtcgttccgtgactggggccgggattgttattgtgcgccaggatgcgataacacctgcggtaaacgttttggtcagcaattggggtcacttcctcaaggctatgatcacaaatatacttattcccacctcggatataatctcaaaatcacggacatgcaggcagcatgtggtctggctcagttagaacgcgtggaagagtttgtagagcagcgtaaagctaatttttcctatttgaaacaaggtttgcaatcttgcactgaattcctcgaattaccagaagcaacagagaaatcagatccatcctggtttggcttccctatcaccctgaaagaaactagcggtgttaaccgtgtcgaactggtgaaattccttgatgaagcaaaaatcggtacacgtttactgtttgctggaaatctgattcgccaaccgtattttgctaatgtgaaatatcgtgtagtgggtgagttgacaaataccgaccgtataatgaatcaaacgttctggattggtatttatccaggcttgactacagagcatttagattatgtagttagcaagtttgaagagttctttggtttgaatttctaatttttgagggggggggattcccctctatgatttcatgaaaattctaataatgggagcgtttgggttccttggatcacgacttacatcctacttcgaaagtcgacatactgtgattggcttagcaaggaagaggaacaatgaagctaccataaataatattatttacacgacagaaaataattggatcgaaaaaatactagaatttgaaccgaatattattattaacactattgcttgctatggaagacataacgaacctgcaacagctttaatagaaagcaatattcttatgcctatcagagtattagaatctatctcatcacttgatgcagtattcataaattgtggaacatcactgccaccaaatacgagtttatatgcatatactaaacaaaaagcaaatgaactcgccgccgccattatagataaagtttgcggtaaatatatagagttaaaattggagcatttctatggagcttttgatggagacgataagtttaccagtatggttattagacgttgtttaagtaaccagccagtaaagttaacatctggtttgcaacagagagatttcttgtatataaaagatctactaacagcgttcgattgtattataagtaatgttaataatttccccaaatttcatagtattgaagttggtagtggagaggcgatatcaattcgtgaatatgtagatactgttaaaaatatcacaaaaagcaattctataattgaatttggcgtggtcaaagaaagagtaaatgaattgatgtatagttgtgctgatatagcagaacttgaaaaaataggatggaaaagagagttctctcttgttgatgcattaactgaaataattgaagaggaagggaaatgaagcttttaattaccggtggatgtggcttccttgggagtaatcttgcctcctttgctttaagtcaagggattgatttaattgtattcgataatctatcacgtaaaggtgcaacagataatttacattggttatcctccttaggaaactttgagtttgtacatggtgatattcgcaacaaaaatgatgttacaagattaataactaagtatatgcctgatagctgttttcatcttgcaggtcaagtggcaatgactacatctattgacaatccttgtatggattttgaaattaatgtaggtggaactttaaatttacttgaggcagtacggcagtataattcaaattgtaatataatttattcatcaacaaataaagtatacggcgatcttgagcaatataaatacaatgaaacagaaactagatacacttgtgtagataagcctaatggatatgatgagagcacacaattagatttccactcaccatatggttgttcaaaaggtgctgcagaccaatacatgcttgattatgcaaggatttttggtttgaatacagtggtgttcaggcattcatcaatgtatggtgggagacagtttgctacttatgatcaaggctgggtaggttggttttgtcaaaaagcggttgaaattaaaaatggtattaataaacccttcactatttctggtaatggtaagcaagttagggatgttttgcatgctgaagatatgatttcgttatatttcactgccttggcaaatgtatcaaaaattagggggaacgcttttaatattggtggtaccattgtcaacagcctatcattacttgaattattcaaattgcttgaagattattgcaacatagatatgaggttcactaatttacctgtaagggaaagtgatcagcgtgtttttgttgcagatattaaaaaaatcactaatgcaattgactggagcccgaaagtctcggcaaaagatggtgtccagaaaatgtatgattggactagttctatatgatgtttctgcccgcgaaagcgggcataattaaagaatgaaatattttttataattaaaagatgaagctgacgtgaggaaactgaggttggttagaattccaagacatcttattattgccgcttcctcttggctttcaaagataataattgccggtgttcagttagtaagtgttaaatttcttttagaaattcttggcgaagaatcatacgctgtatttactcttttaactggattattggtctggtttagcattgcagatattgggattggtagtagtctacaaaattatatatctgagttgaaagctgatagaaaatcatatgatgcatatatcaaggccgcagttcatattctattcgcatccttaatcattttaagctctacattattcttcttatcagataaattatcgtcactatatcttacttcatttagcgatgaattgaaaaacaactcaggaagttatttttttatagcaagtatattatttatattcatcggcgttgggagtgtggtctataaaatattatttgcggaactgttagggtggaaagctaatataattaatgcattatcttatcttttaggttttttagatgtagttgcgatccattatttaatgccagattcgagtattaccttcgctttagtagcattgtatgctccggtagcaatactgcccattatatatatatcgtttcggtatatatatgttcttaaagcgaaagtaaactttaacacctataaattattactatcacgttcatcagggtttctgattttttcgtccttatcgataatagttttacaaactgattatattgtgatgtctcagaaattatctgctgcagatattataaaatatactgtaacgatgaaaatatttggtttaatgttttttatttatactgcggtattacaagcattatggccagtatgtgctgaattacgagtgaaaatgcagtggagaaagctgcatagaatcattttcctaaatattattggtggggtattttttattggtcttggtacgttatttatttatgttttaaaggattatatctatagcataattgctaacggtatagattataatattagtggggttgtttttgttttactggctgtgtattttagtataagagtttggtgtgatacatttgctatgttacttcaaagtatgaaccaattaaaaattctttggctcatagttccgtgtcaggcattaattggtggtgtgactcaatggtattttgcagagcattatggaatagttggtattttatacggactaattttatcgttctcgctaactgttttttggggattgccagtgtattatatgtataagagtaaaaggctagcataatatgaaggtatcattttgtatcccaacgtataatcgagtaaaattcattgaagaccttcttgaaagtattaataatcaatcttctcactccttaattgtagaagtatgtatttcagataatgcatcaactgatggaactgaagaatcaataaatatctggagagatagatttaattttccaattttatatcaaaggcataacgaaaatattgggccagataggaattatttatctgcagttaatatggggactggagattattgttggattttcggaagtgatgatattcttacaaaaaattcccttgcattgatggaagataaattggctgccggaagtgacatttatttatgtgacagacgagaattagatatttcaatgacgaaaatatctaatccacatcggcgatggttaaatggtggcagtagattattttcttttagcaatgaagctgatttgatagagtactttagtaaatgtaactcagtcggcggactttttagctacttaagctctattatagtgaaaaggaataaatggtctgacgtcttatttgacgagtcatacattggtacagcttatgcgcatgtatatattttattaagaataattaacaatatgaattcgaccctgcagtacatatcactgccactggttgattgcagaggagataacgatacattcgaaagtaatgggaaggctcgtcgaataaaaattgatttcatcggttatttaaaactgagggaggatttttataataacaatacaaaaatatatatctcatttggacgggttcttacaaaagagcgtccttggctttatacttctttagctatggcatgttatggtgattctaccgatagagctgaacttgcatcattttataagaagttgggatatccgaaaatagccaccaatttaatattttgtcttaaagggctggctagctacactaaaaaaataaaattagcaaaaatggtaataaaaaaaatattttcatagtatcaacatcaatacaaatcgagtttatagtgtaaaaaatgcttatgctattattgtcgtgactatttagcgtaaagtttatacgtgttttgtaggatgatttatttgcaatttccttaattagaacctttaaatactcttgctttttcggatacagtaacagatgctatatatgtatctataatatgtatggccggggttgtttttgactatttatcaatttcaaaattaagacttgtggcaattagagcttgtcggaaaccctacttttctttcttttgctcactatgctcttgcatatcttagtgtttaccatagagtgagtatattatgacagatgctattttttgtggcatttttacttggtataatatttggcttagtattatgaactgattttaatggtgattttataataattacaaggcttgcttatatttatttggatatgattccttattcatttttaattatgatccgtggttcattttaatgaaaatgtttcctaataactattggtcgttcttgtgataatcgctatacaagcatgaatggaaaaacggagagctattcaatgatcgttaacctatcacgtttaggtaaaagcggtacggggatgtggcaatactcgattaaatttttaacggctctgcgagaaatagctgatgttgacgcaataatctgtagcaaggtacacgctgattattttgaaaagctcggttatgcagtagttactgttccgaatattgttagcaacacatcaaaaacatcgcgacttagaccattagtatggtatgtatatagttactggcttgcgctgagggttttaattaagtttggtaataaaaaattggtgtgtactacgcatcacactattcccttactgagaaaccaaacgataaccatacatgatataagacctttttattatccagatagtcttattcagaaagtgtattttcgctttttattaaaaatgtctgttaagcgatgtaagcatgttttaacggtatcttataccgttaaagatagcattgctaaaacttataatgtagatagtgagaaaatatcagtaatttataacagcgttagtaaatctgattttatacaaaaaaaagaaaaagagaattactttttagctgttggagcaagttggccacataaaaatattcattcattcataaaaaataaaaaagtttggtctgactcttataatttaattattgtatgtggtcgtaccgactatgcaatgtctctccaacaaatggtcgttgatctgaaactaacagataaagtgacttttttacatgaagtctcatttaatgaattaaaagttttatattctaaagcctacgcgcttgtttatccatctattgatgagggttttggcatacctcctattgaagcgatggcatcaaatactccagttatagtgtccgatataccagtatttcatgaagtgttaaccaatggtgcattatatgtgaatccggatgatgaaaaaagctggcagagtgcaattgaaaatatagggcagttgcctgatgcaatttccagatttaacaactatgtcgcacggtatgactttgataatatgaagcagatggttggcaattggttggcggaatcaaaataaatgaaaataacattaattattcccacatataatgcagggtcactttggcctaatgttctggatgcgattaagcagcaaactatatatccggataaattgatcgttatagactcaggttctaaagatgaaacggttctgttagcctcagacctgaaaaatatatcaatatttaatattgactctaaagattttaatcatggaggaaccagaaacttagcagttacaaaaactctggacgctgatgttataatttttctaacacaagatgcaattctcgcggattcggatgcaattaaaaatttggtttattatttttcagatccattgatagcagcggtttgtggtagacaacttcctcataaagatgctaatccccttgcagtgcatgctaggaattttaattatagctcaaaatctattgttaaaagcaaggcagatatagaaaaatttggtattaaaactgtatttatgtccaattcttttgctgcctatcgccgttccgtttttgaagagttaagtgggtttcctgaacatacaattcttgccgaggatatgtttatggcggctaagatgattcaggcgggttataaggtcgcctactgcgctgaagcggtggtaaggcactcccataattataccccgcgagaagagtttcaacgatattttgatactggtgtatttcatgcttgttctccgtggattcagcgtgactttggcggagccggaggagagggtttccgattcgtaaaatcagagattcaattcctgcttaaaaatgcaccgttctggattccaagagctttattaacgacctttgctaaattcttgggttacaaattaggcaagcattggcaatctttaccgttgtctacatgtcgctattttagcatgtacaagagttattggaataatatccaatattcttcgtcaaaagagataaaataaatgtcttttcttcccgtaattatggctggcggcacaggtagccgtttatggccgctttcacgcgaatatcatccgaagcagtttttaagcgttgaaggtaaactatcaatgctgcaaaatactataaagcgattagcttcactttctacagaagaacccgttgtcatttgcaatgacagacaccgtttcttagtcgctgaacaactccgtgaaattgacaagttagcaaataatattattctcgaaccagtaggccgtaatactgcaccagcgatcgctcttgccgcgttttgtgcgctccagaatgctgataatgctgatcctcttttgttggttcttgctgcagatcatgtgatccaggatgaaatagcgtttacgaaagctgtcagacatgctgaagaatacgccgcaaatggtaagcttgtaacttttggtattgttccaacgcatgctgaaacgggttatggatatattcgtcgtggtgagttgataggaaatgacgcttatgcagtggctgaatttgtggagaaaccggatatcgataccgccagtgactatttcaaatcagggaaatattactggaatagcggtatgtttttatttcgtgcaagctcttatttaaacgaattgaagtacttatcacctgaaatttacaaagcttgtgaaaaggcggtaggacatataaatcccgatcttgattttattcgtattgataaagaagagtttatgtcatgcccgagtgattctatcgattatgcagttatggagcacacacagcatgccgtggtgataccaatgagtgctggctggtcggatgtgggatcctggtcctcactttgggatatatcgaataaagatcatcagagaaatgttttaaaaggagatatcttcgcacatgcttgtaatgataattacatttattccgaagatatgtttataagtgcgattggtgtaagcaatcttgtcattgttcaaacaacagacgctttactggtggctaataaagatacagtacaagatgttaaaaaaattgtcgattatttaaaacgaaatgataggaacgaatataaacaacatcaagaagttttccgctcttggggaaaatataatgtgattgatagcggcaaaaattacctcgtccgatgtatcactgttaagccgggtgagaaatttgtggcgcagatgcatcaccaccgggctgagcattggatagtattatccgggactgctcgtgttacaaagggagagcagatttatatggtttctgaaaatgaatcaacatttattcctccggatactattcacgcgctggaaaatcccggaatgatccccctgcagttaattgagattcaatcaggtacctatcttggtgaggatgatattattcgtttagaacaacgttctggattttcgaaggagtggactaatgaacgtagttaataatagccgtgatgttattcattcatcaggtattgtgtttggaacgagtggggctcgcggtcttgtaaaagattttacacctcaggtatgtgctgcttttacggtttcatttgttgccgttatgcaggaacatttttcctttgataccgtagcattggcaatagataatcgtccaagtagttatgggatggctcaggcgtgtgctgctgcattggcagataaaggcgttaactgtattttttatggtgtggtaccaaccccggctttggcctttcagtctatgtctgacaatatgcctgcgataatggttacgggaagtcatattccattcgagcggaacggcctcaagttttatcgtcctgatggtgaaatcacgaaacatgatgaggctgcgatccttagtgttgaagatacgtgcagccatttagagcttaaagaactcatagtttcagaaatggctgctgttaattatatatctcgttatacatctttattttctactccattcctgaaaaataagcgtattggtatttacgaacattcaagcgctgggcgtgatctttataagcctttatttattgcattgggggctgaagtcattagcttgggtagaagcgataactttgtacctatagatacagaggctgtaagcaaagaggatcgggaaaaagcacgctcatgggctaaagagttcgatttagatgccatattctcaacagatggggatggtgatcgtcctcttattgctgatgaggccggtcagtggttaagaggcgatatattaggtctattatgttcacttgcattgggggcagaagcggtcgctattcctgttagttgtaatagcataatttcttctggccgcttttttaaacatgttaaacttacgaaaattggctcgccttatgttatcgaagcttttaatgaattatctcggagttatagtcgtattgtcggttttgaagccaatggcggttttttattaggaagcgatatctgtattaacgagcagaatcttcatgccttaccaactcgtgatgctgtattaccagcaataatgctactttacaaaagtaggaatatcagcattagcgctttagtcaatgaactcccaactcgttacacccattctgacagattacagggaattacgactgataaaagtcaatccttaattagtatgggcagagaaaatctgagcaacctcttaagctatattggtttggagaatgaaggtgcaatttctacagatatgacagatggtatgcgaattaccttacgtgatggatgtattgtgcatttgcgcgcctctggtaatgcacctgagttacgctgctatgcagaagctaatttattaaatagagctcaggatcttgtaaatataacgcttgctaatattaaaaaacgatgcttgccgtaaaagaattgaatgttatttacttaatatgcctattttatttacattatgcacggtcagagggtgaggattaaatggataatattgataataagtataatccacagctatgtaaaatttttttggctatatcggatttgattttttttaatttagccttatggctttcattaggatgtgtctattttacttttgatcaagtacagcgatttattcctcaagaccaattagatacaagagttattactcattttattttgtcagtagtatgtgtcggttggttttggattcgtttgcgacattatacataccgcaagccattttggtatgagttaaaagaaatttttcgtacgatagttatttttgctatatttgatttggctctgatagcgtttacaaaatggcagttttcacgctatgtctgggtgttttgttggacttttgccataatcctggtgcctttttttcgcgcacttacaaagcatttattgaacaagctaggtatctggaagaaaaaaactatcatcctggggagcggacagaatgctcgtggtgcatattctgcgctgcaaagtgaggagatgatggggtttgatgttatcgctttttttgatacggatgcgtcagatgctgaaataaatatgttgccggtgataaaggacactgggactatttgggatttaaatcgtacaggtgatgtccattatatccttgcttatgaatacaccgagttggagaaaacacatttttggctacgtgaactttcaaaacatcattgtcgttctgttagtgtagtcccctcgtttagaggattgccattatataatactgatatgtcttttatctttagccatgaagttatgttattaaggatacaaaataacttggctaaaaggtcgtcccgttttctcaaacggacatttgatattgtttgttcaataataattcttataattgcatcaccacttatgatttatctgtggtataaagttactcgagatggtggtccggctatttatggtcaccagcgagtaggtcggcatggaaaactttttccatgctataaatttcgttctatggttatgaattctcaagaggtactaaaagaacttttggctaacgatcctattgccagggctgaatgggaaaaagattttaaactgaaaaatgatcctcgaatcacagctgtaggtcgatttatacgtaaaactagccttgatgagttgccacaactttttaatgtactaaaaggtgatatgagcctggttggaccacgacctatcgtttcggatgaactggagcgttattgtgatgatgttgattattatttgatggcaaagccgggcatgacaggtctatggcaagtgagtgggcgtaatgatgttgattatgacactcgtgtttattttgattcctggtatgttaaaaactggacgctttggaatgatattgccattctgtttaaaacagcgaaagttgttttgcggcgagatggtgcgtattaagcttaccgagaagtactgaataataattgtataaaatagcctgcgtaaaatctgaacgcatcaatcgctaccttaatatcatacctttgagttaacatactattcacctttaacctgccatgaccgtttgtggcagggtttccacacctgacaggagtatgtaatgtccaagcaacagatcggcgtcgtcggtatggcagtgatggggcgcaacctcgcgctcaacatcgaaagccgtggttataccgtctccgttttcaaccgctcccgtgaaaagaccgaagaagtgattgccgagaatcccggcaaaaagctggtgccttattacacggtgaaagagtttgttgaatccctcgaaacgcctcgtcgtatcctgttaatggtgaaagcgggtgcaggtactgatgcagctatcgattcgctgaaaccgtatctggaaaaaggcgatatcattattgatggcggtaacaccttcttccaggacacaatccgtcgcaatcgcgagctgtctgcggaaggttttaactttatcggtaccggtgtttccggtggtgaagagggcgcgctgaaagggccatctatcatgcctggcggtcagaaagatgcctatgaactggtggcgccgatcctgacgaagattgctgctgtggcagaagatggcgaaccgtgcgtgacctatatcggcgccgatggcgcgggtcactacgttaagatggtccacaatggtattgaatatggcgatatgcagcttatcgctgaagcttactccttgctgaaaggcggcctgaatctcagcaatgaagagttggcgaacacttttactgagtggaataacggcgagctgagcagttatctgatcgacatcactaaagacatcttcactaaaaaagatgaagacggtaattacttgatagatgttattcttgatgaagccgccaacaaagggaccggtaaatggaccagccagagcgcgctggatctgggcgaaccgctgtcgctgattaccgaatccgtctttgcgcgttacatctcttcgctgaaagcgcaacgtgttgccgcatctaaagtgctctccgggccgaaagcgcagccggcgggcgacaaagcggaatttatcgagaaagtgcgtcgcgcgctgtatcttggcaagatcgtctcctatgcgcagggcttctcgcagctacgcgccgcgtctgatgaatatcactgggagcttaactacggcgagattgctaagattttccgtgcgggctgtatcattcgcgctcagttcctgcagaagatcaccgatgcttacgcagaaaacgccggtatcgctaacttgctgttagcgccttacttcaagaaaattgctgatgagtaccagcaggcgctgcgtgatgttgtggcttacgcggtgcagaatggcattccggtgccgacattctctgcggcagtggcctactatgacagctatcgcgccgcagtactgccagctaacttaattcaggcgcagcgtgactactttggtgcgcacacctataaacgtactgataaagaaggcattttccataccgagtggttggaataatttctgcaagcttgtttaagcccggtttaatactgggcttttttttatctctattcttattgatttatcgcttttgcttaatattaacttaataatctgtgtttatcgtaatgaagataatctgaattgttttcgtctgcgttgcactttatatactcaggcgttaaaactttgatatcttatcaggatgcgaaatacatcatgattcataattaagttaattctgagagcgaataatgaaaatcacgatatccgggacgggttatgttggcttgtctaatggtttgcttattgcacaacaccatgatgtggtggcgttagacattgttcctgcccgtgttgaactgttaaatgatcggatatctccgattgttgataaagaaattcagcaatttttaaaggaagataacatcagattcagggcaacgctggataagtttgatgcataccagaatgcagattacgtcatcattgctacgcctacagattacgatccaaaaaccaactattttaatacgttcagtgtagaatcggtcattcaggatgtgatcagcatcaaccccgcagccgtgatgattattaagtctacggtgccggttggctttacggcggcaatgcgtcagaagtttgcgacagaaaatatcattttctctccggaatttttacgtgaaggtaaagccctttacgataacctttatccctcccgtatcgtgattggggaacagtctgagcgcgcccgagaatttgccgcattactccaggaaggcgctattaaacaggagattccgacgctgtttacggactccactgaagcggaagccattaaacttttcgccaatacttacctcgccatgcgagtcgcttattttaatgaattagacagttatgctgaaacgttaggattaaatacccgacaaattattgaaggggtgtgcctcgacccgcgtattggcaatcattacaataatccctcttttggttatggcggatattgtttgccaaaagataccaaacagttgctggctaattatcagtcagtgcctaataatattatctccgctatcgttgaagcaaaccgtacgcgtaaagattttattgccgattctatccttgccagaaagcctaaagtggtgggcatttatcgcctgattatgaagagtggctccgataacttccgcgcctcatcgattcaggggattatgaaacgtattaaagcgaaaggcgtagaggtcatcatctatgagccggtaatgcaagaagaaactttctttaactcacgtcttgaacgtgatttgcactgctttaaacagcaggcggatgtcattatttccaatcggatggcggcagagcttttggatgtcgctgaaaaagtgtatacccgcgatcttttcggtagtgattaataaggcaatcggggctgatgagtcccgatgatttattgaccaaatggaaataatgtctgatttttatcattaatcctatggcatatattttctttatgactacactgtctccagcttcatcctttttttagttagggtatctatgacagtggatagtaatgcgtcttccgggcgtgggaacgatccggaacagattgatttgattgagttattgctacagttatggcgtgggaagatgaccattattgtagccgttattatcgccattttgctggccgtaggctacctgatgatagccaaagaaaaatggacatccacggcgattattacccaacctgatgccgcgcaggttgccacctataccaacgcgctcaacgtcttgtatggcgggaatgcccccaaaatctctgaagtgcaggcgaattttataagccgctttagttctgcgttttccgcattatcggaagcgctggataatcagaaagagcgggaaaagctcaccattgaacagtcggtaaaggggcagacgctgccgctctcggtttcttatgtgagcactaccgctgaaggggcgcagcgtcggctggcggaatatatccaacaggtggatgaagaggtcgctaaggaactggaagttgacctgaaagataacatcacgctgcaaaccaaaacgttgcaggagtcccttgagacgcaggaagttgtggcgcaggagcaaaaagatctgcgtattaagcaaatcgaagaagcgttgcgctatgcggatgaggccaaaatcacgcagccgcagattcagcaaacccaggatgttacccaggacacgatgttcctgttggggagcgatgcgctaaaatcgatgatacagaacgaagcgacgcgtccactggtcttttctccggcctattaccagacgaagcagacactgctggacattaaaaatctgaaagtgactgccgatacggtgcacgtctatcgttatgtgatgaagccgacgctgccggtccgtcgcgatagcccgaaaacagccattaccctcgtgctggctgtgttgctgggcgggatgatcggcgccgggattgtgctggggcgcaatgcgctacgtagctataagccaaaagccttgtaagcttctttgccggatggtggtcggcttcgaaaggtaaaatttctcattaaaaaaccgggcattgcccggtttttttacgcttattgatgacgcttacgaagatcgtcgatcacggtggtgaggttgagatcctgatcctgcaacagcaccagcaggtggtacatcaaatcagacgcttcattggttaattcaaaacgatcattgacggtggccgccagcgcggtttctacaccttcttcgccaactttttgcgcaatacgtttggtaccgctggcgtacagtttcgccgtgtaagagctggccggatcggcggttttgcgctctgccagtagctgctccagttgatacaggaataaccactgatggctggcgtcgccaaagcagctgctggtacctttgtggcaggtcggcccgacagggtttgccagcaccagcagtgtatcgttgtcgcaatctggcgcaatgctgacgacattcagcacatggcctgaggtttcgcctttggtccataaacgctgtttcgtgcgtgagaagaacgtgacatggccggattcaatggttttgtccagcgcttgtgggttcatatagcccagcgtcaatacttcgccggataccgcatgttgcacgatggctggcatcaggccatcggttttttcccagtccagctcgcggcgttgttgctctgttaacatatcctgatctccacgccctggcctgccaggtacgcttttaattcgccaatattgatgatttgcttgtgaaaaacggaggcggcaagcgcgccgtcgacatcggcatcacggaatgcctcaagaaagtgttccatcgtgcccgcgccgccggaggcgatcagcggcacgcggcaaacgtcacggacttttttcaactgcgtcagatcataaccgttacgcacgccgtcctggttcatcatattcaggacgatttcccccgcgccgcgctgttgtacctcttgcacccagtccagcgtctcccactgcgtcacgcgggtacggttttcatcgccggtatactggttaacatgatatttccccgtggcgtcgtcaaaccaggtatcaatcccgacgacaatgcactgcacgccaaaacggtcagccagacgggtaatcagcgttgggtcagccagtgcaggggagttgatagagatcttatccgccccgaaagagagaattttggcggcgtcgtcaattgaccggataccgcccgctacacaaaacggaatgtcgatcacctcggcaacgcgcgctacccagcttttatcgactacgcgaccatcgctggaggcggtaatgtcatagaacaccagttcgtccgcgccttcgtcggcatagcgtttggccagcggaacgatatcgccaatgatctcatggttgcgaaactgtacgccttttaccacctgaccatcacgaacgtccagacacggaattatacgttttgccagcattggatggcctccttaacggtaaatttcccttccaacagcgcgcgtccgacaatcacgccgcgcacgccggtgccgcgcagggcggcaatatcatcgatatcgccaataccgccggaggattgaaaggcgatctgcggatatctggcgcatatctcttcgtacagtgaaacgttagagcccgccagcgtgccgtcgcgagaaatatcggtacacagtacatgtttcaggccgacggggagataggtctccaccagttgttccagcgagacgccggaattttcctgccagccgctaaccgccacctgcttgttgccgtgttcgtctatgcgaacgtccagcgccagtaccagcgcctgcgcgccaaaacgttcaaaccagcctttcaccacgtcaggggatttcaccgccgttgaaccgatgaccacacgggcaacgccagctttcagtaatgccgcaacgtcttcttcggtacgcacgccgccgccgacctgaacaggcacgttcacgcccgcgaccagagttttaatcagcggtatctgtcgcttagccggatctttagcgccggtcagatctaccagatgtagcaccccggcgccctgggcggcgtaatcctgcaaacggggcaggggatcgttaccgtaatcccgctgccgggcgtagtcgccctggtggagacgcaccacggtgccgtcaattaaatctaatgccggaataatcattacatctccaggaagtttttcagcaactgtgcacccgccgcgcccgaacgttccggatggaactgtacgccgaagaaattatctttctgtaccgccgcggtaaacggctcgccgtaattgcactgggcgatagtccacgggttgaccggcatcgcgtagctgtgaacaaagtaaaaataggcgccatcttcaatgccctgaaacagccggttgcccgcctgcggatacacgcgattccagcccatgtgtggcagcggcagaccaaagtcggtcattttcggcacatcttgttcgataatgttcagcagatccacgccgcgtgtctcttcgctgcgacgacccagcagttgcatccctaagcagatacccagtaccggctgagtacacgctttaattaagtcgatcagttcacgttcgcgcagttgatccatagcggcttgcgccgtgccgacgccgggcagaaagagtttgtcagcgcgtaatacgatttccgcttcgcggctgaccaccggggtgtaaccgtggcgcgccacggcggattttaccgagcttaaattggcgcagccggtgtcaaggatgacgacgttcatcacagcactcctttcgaggacggtaatgtatcgccctccacgcgaatagcctggcgtagcgtccgaccaaaggctttaaacaaactttcgacacggtggtgatcgttcttacctttagtcttgagatgcagagtgacgcccatcgtgtaagagagtgagcggaaaaagtgttcaatcatctctgtgctcaaatcgcccacacgctggtaggtaaattcagctttatattccagatgcggacgaccggaaatatccagcgcgcagcgcgccagacattcatccatcggtagtacaaagccaaaacggcagataccgcgcttgtcgccgagtgccagttttaacgcctcaccgagcgccagcccggtatcttctaccgtgtggtgatcgtcgatatagagatcgcccttaacggtaatctccatgcgaaagccgccgtgggtggcgatttgatcgagcatatggtcaaagaagccgacgccggtattaatcttgctgttgccttcgcgatccagccagacgctgacatcaatctgtgtctctttggtgttgcggaccacatgcgcatagcgatcgcgtttcgttagctgttcgccaatcatcgtccagttcaacgtttcacggtgatagcgtaaaccagtaatgcccatattatcagcgagttggatatcggttgcacgatcgccaatcacatagctgttggcgctatccatcgcttgttccgcaagataacgctccaccagcttcactttgggcttgcggcagtcgcagtcgtctgcgggcaggtgagggcagatcagcacctcatcaaagcatacgccctgagaagtgaaaatctgcatcatcaggttgtgcggtccgtcgaagtccgcctgcgggaagctttgcgtgccaagtccatcctggttagtgatcatcaccagcttaaaaccggctttttgcagcttcagcaatacgggaatcacctctggctcaaaggccagtttatcaaagtggtctacctgaaaatcgctcggcggttcggaaattaaggttccgtcccggtcgatgaaaagatacttctgactcatactggctccgcacgtaaggcgtcaatgacgcgctggttttcctggcgggtgccgaccgtaatccgcaggcagccgcttaaagaaggttgtttattctgatcgcgtaagataatgccctgatcccataaggatttaaacacgctgctggaggcggtaaaccgcgccagaatatagttggtttcagagtcaaagacgtgttctacgcaggcggtctgttgcagggcattcaccagatactgacgttcctgcactgtctgcgccacgcgatcgcgcattacgtttattccctgcgggctcagcgcttgggcggcgatatccgccactggcgtagaaagcggataaggggcgatcacttttaacagcaggttgatcacctcttcattagccagcgtaaagccgcagcgcagacccgccagcgcaaaagctttcgacaatgtgcgcaggataaccagatgaggatatttaaccagccagcctgccagcgtggcctgcgggcaaaactcaatataagcttcgtcggcgacgactatcgctttaccgcgtgtcaactccagcagcgtgcgcagatcctgcgggttgataagttgcccggtaggattattggggctacaaacgaacaccacttttgcgccgtcaaggttgtcggaaatcccctgtagatccagctgccagttttcaagcgcgggaaccgtccggcgctctacgccaatggtttcggcgctgacgctgtacataccgtaagtgggcggacagtagagaatggcgtctttccccggttcgcagaaggcgcggatcaccagttcgatcccttcatccgcgccgcggctgaccagcacctgctccggctttacgccagcatattgcgcgtagttttcaatcacggcctttggctggcattccgggtagcggttaagcgtttgttgggtgagctgaaactccaccgctgtcgggaattcattcgcgttcagccagacatcgccgttaccgcccagacggcgggcggactgatacggtaccaggttgcggacattttcacgggctaagtctgcgacgctgagagtgttttcagtgctcatgcttgctccttgagggcgtttacgcgcagggtcacggcatttttatgggcggtcagacgttctgccgccgccaatgtttcaatggttgatgccagagcggaaaagcccgctttcgacagttcctgaacggtcatccgtttctggaaatccgctaacccaaggctggaacaggtagcagtatagccataggtcggtaaaacatggttggttccggaagcgtaatcaccggcggattccggcgaccagtcgccgagaaataccgagcctgcgctggtaatcgcatccaccaaatcgcgcgcattgcgcgtctggataattaagtgttccggcccatactgattagagatggcgacgcactgcgctaaatctttggtcacaatcagacgactggcgctcagggcctgccgggcggtgcccgcgcgcggcagttccgccagttgacgttctaccgcctccgccaccttgcgggcaatgtcagcatccggcgtcagcaggatcacctgggaatccgggccgtgctcagcctgggagagcaggtcagaagcgacgaaatccggtgttgcgccgctgtcggcgatcaccagcacttcagacggcccggctggcatatcgatagccgcgccgtcgagacgctggctgacctgacgcttggcttcggttacaaaggcgttgccggggccaaaaattttatccactttcggtacggactcgctgccgaaggccagagcggcaatcgcctgcgcgccgccgacgttaaagatttcctgcacgccacacagttgcgccgcatagaggatttcatcagcgatgggtggcggcgagcacagaaccaccttctggcatcccgcaatgcgcgccggcgtcgccagcatcagcaccgttgagaagagcggagccgagccgccgggaatatacagaccgacagacgcgacgggacgcgtaacctgctggcaacgcacgcctggctgggtttccacatctacaggcggtagcgtctgcgcggaatggaacgtttcaatatttttgacggcagcggccatcgcctgttttaattcgtcgctcagacgcgcgccggcggcggcgatctcttcaggggtgacgcgtagcgctgtcacttctgttttatcaaatttagcgctgtattcacgcagggcatcgtcaccgcgcgtttttacattatacagaatatcgctgaccgtccgggtaatactgtcagaggcggaaatcgccggacgcgtcagcagcgcacgctgctgttcagggctacagctgttccagtcaatcagggtattgaagctcatggtctttactccatcacagggttccgccttatccggcctactgaacccaaaatatcaacgcattacgtaggcctgataagcgcagcgccatcaggcgtcagatcactccatcatcttctcgatcggcagtaccagaatcgagctggcgccaagcgctttcagtttctccatggtttcccagaacaacgtttcgctgctgaccatgtgcatcgccacgcgctgttgctcgcctgccagcggcagaattgtcggcctttcggcgcctggcagcagggcgataacctcttccagtcgttcacttggcgcgtgcatcatgatgtatttcgattcgcgcgcctgaatcacgccctgaatacgggtcagcaatttatcgatcagctgttgcttgctctgtgccatctcaccgtcgcgctgaatcagacaggctttagagcggtagataacttcgacttcacgcaggccgttagcttcaagcgtcgcgccggtagagaccaaatcgcagatagcgtcggccagccccgcgcgcggcgcgacttcgacagaaccatttaacagacacgatttaaaagagacgcctttctggtcgaggtagcgtttgaggaggtgcggataagaggtagcgatacgtttaccgtccagcgcggccgggccgtcccaggcttcgtcaaccggcgttgccagcgataaacggcagccgccgaagtcaagacggcgcagggttaaatagcgtggatcttcgccctgcgcgcggcggttgagtagctcttcttccagcacgttttcgccgataataccgagatcgaccacgccatccatcaccagacccggaatgtcatcatcacgcacgcgcaggatatcaatcggcatgttttccgccatcgcaatcaggcgctgagtgtgtaaattaatttttatgccgcagcgggccagcaattctcgtgaatcatcgcttaaacggcctgatttctgaatagctatgcgtaagcgggtgttgtctaacattctgcgttcctctttatcctgtctgaaccggtctgtatcgcgcgccaaaaaaaaagcccccggaagatgatcttccgggggctttctcatgcgttcatgcaccactggaagatctgaatgtcttccagcacacatcgcctgaaagactagtcaggatgatggtgatgtttaaattgaacgcgtgtcataaaaattccgatgaatgcttattcatttgataccttttaacctaaaccacttttacgccttaaagcaagcgcttttttcatttcgcatttatagtatgaattgtcagtcacggcgggctggcgtagccttatgtataaggcgttaaagtcaggagaaaatggatgaaaaaggtcgcaattgtcggtttaggttggttaggcatgccgctggcaatgtcgctggcagcgagaggctggcaggttaccggcagcaaaaccacccttgacggggtggaagcggcccgtatgagtggaattgaaagctatccgctgcgtctggagccggagctggtctgtgaggcggacgatcttgacgctctgctggatgtcgatgcgctggtgataacactgcccgcgcgccgtagcggtccgggagaggatttttatctgcaggcgatgcaggagctggtcgacagtgcgctggcttatcgtatcccgcgtattatttttaccagttcgacgtctgtttacggcgatgcgcaaggcgtggtgaaagagaatacgccgcgtaatccggtcacggccagcgggcgtaccctgaaggaactggaagattggctgcataatctgccgggcacgtcagtggatattctgcggctggcggggttagtcgggcctgggcgccatcccggacgtttctttgccggaaaaaccgcgccggatggtcaacacggggtcaatctggtgcatcttgaagacgtggttggcgcaattacccttttgctacaggcgccaaaaggggggcacatctataatatatgtgcgccggcgcatccagcccgcaacgtgttttatccgcaaatgacgcgcttgctgggaatggcgccgccgcattttcgtgacgcaccggacaacggcaaagggaagattatcgacggtagccggatttgtaatgagctgggatttgaatatcaatatcccgatccgttggtgatgccgatggagtgagtcgctgtccagcaggtggtcgccatatagcgcaaggggacgagtatgaaaccactgctggacgttctgattattcttgatgcgttagaaaaagaaggcagcttcgcggcggcgtcggcaaaattatttaaaacgccgtccgccctcagttataccgttcataagctggaaaacgatcttaatatccaactgctcgaccgtagcgggcatcgcgcgcgatttacgcgaaccggtaagatgctactggaaaaaggccgtgaagtgttgcacaccgttcgcgagctggaaaagcaggcgattaaactgcatgaaggctgggagaacgaactggtcatcggtgtggatgatacctttcccttttctcttctggccccgcttatcgacgctttttatcaacgccacagcgtgacgcgccttaaatttgtcaatggcgttctcggcggttcatgggagacgctgacgcagggaagggcggatattattgttggcgccatgcgcgcgccgccgcctgacaccggctttggctttgcaagactgggcgatcttgaactggtgtttgctgtcgccccgcatcatccgctggttcatgaagaggaaccgcttagccgccagacgatcaaacgttttcgcgcgattgtggttggcgatagcgtccattcctcgcgatcaatagggtctgaactgctcgacgctcaggaagcgattaccgtgtttgattttaaaaccaagctggagctgcaaattagcggcctgggatgcggctatttaccgcgttatctggcgcagcgatttttggaaagcggcgcgcttatagagaagaaagttgtggcgcaaatcgtctatgaaccggtgtgggttggctggaatgaacagaccgccgggctggccagcggctggtggcgggatgaaattttagcaaataatgctattgctggggtgtatgcaaaatcgccggtttaaaaatcaatcgcttatgaaaaataattttttgaacgcgctcgcattctcttgtcatttcacttcaatttagggcagaatatgccgcttgcaaaaaatgacactaaccgacgttttaatacgcgtcggttatttttttgcttcaaacacatcattcaataccaagaggccgggcttcgtaccggatagatacttacttaaaaatcgacagttgttgtcgctgaggaatccagaaaatggggcaattttttgcttacgcgacggcattcgccgtaaaggagaatgaccatgtcgcataacgttactccaaacacctctcgcgtggaattacgtaaaacgcttacgttagttccggttgtaatgatgggtcttgcctatatgcagccgatgacgctgttcgatacatttggtatcgtttcaggcctcactgacggtcacgtaccgacggcgtatgcattcgcgttaatcgcgattctgtttacggcgttgagctacgggaaactggtgcgtcgctatccttccgcgggttcggcgtacacctatgcccagaaatccatcagcccgaccgttggctttatggtgggttggtcttctctgctcgattatctgttcgcgccgatgatcaacattctgttggcgaaaatttattttgaagcgctggtgccctccattccctcatgggtgttcgtcgtggcgctggtggcctttatgacggcctttaacctgcgcagcctcaaatcggtcgctaacttcaacactgtgattgtggtgctacaggtggtgctgattgcggtcattctgggcatggtggtttatggcgtatttgaaggcgaaggcgccggtacgctggcgagcacccgtccgttctggtccggcgatgcgcacgttatcccgatgattacgggagcgacgatcctgtgcttctcctttaccggctttgacggcatcagtaacctgtcggaagagaccaaagatgctgagcgcgtgatcccgcgtgcgattttcctgaccgcgctgattggcggcctaatcttcatctttgcaacctatttcctgcaattgtacttcccggatatctctcgctttaaagatccggatgcgtctcagccggaaatcatgctgtacgtggcgggtaaaaccttccaggtgggcgcgctgatcttctctactatcaccgtactggcttccggtatggcggcgcatgcaggcgtagcgcgcctgatgtacgtaatggggcgcgacggcgtattcccgaaaagcttcttcggttacgttcatccgaaatggcgtacgccagcgatgaacatcatcctggtcggggcgatcgcgctgctggcgattaattttgacctggtgatggcgacggcgctgattaactttggcgcgctggtcgcgtttaccttcgttaacctgtcggtgatttcgcagttctggatccgtgagaagcgtaataagacgttgaaggatcacttccagtatctgttcctgcccatgtgcggcgcgctcacggttggcgcgttgtgggttaacctggaagaaagctcaatggtactgggcctgatctgggcgggtatcgggctgatttatctggcgtgcgtaactaaaagcttccgcaacccggttccacagtacgaagacgtcgcgtaatcgcgcgtattatcggcaatagtaaaaccggaggcagtgcctccggttttttgtctgccatccagcacgtttaccggatggcggcgtcactatttatccgctctggattaacaatgcccgtcaggcattggtcaattacacaatctcagttgcgtactgccacagtgatttcagcagccccagcttcgttttatcttccgcatactgctgagaaagcatctgcaattcattggcatactgttgtaaaaactctggcgtcagtacctgacggcgatgctccagccagcgctgctgctctgcgtcatccagcgtaccgggaaaattgcgtgcgcggtaattaaacagcagcttctcaatgcgcttatcgacaaaggtaatgtccagcgcgggcaggttacgcggctcggtttcgagtacgattttcatggctgcgcgatcggcatcgctgaaaaaaccatcatagagctgggcatcaacgttatccgaggtggcaaaaggttcggcttcggcgaaaatcgccaccactttgtcgcggacctgcgggttttcacgcagcactttcaggttatccaggcaatgctggcggttaattcccagccggtcggcatcctccgggcgcaaggtattcgcctgcgccagtaccggacatttattgatatgcaccagctttaccggcactgcggcgtgatcgccaagatcggctttggccgtataaagccgctcgcgaagggtgtcgctgtccagctcaagaagaggagaaatatcgcctgctaaatcgaccatgatcaccgcgttacggttttcaggatgccacgccagcggcgcgacccagcttgtattaccgcgccacgcgccaaacatgccggagacatgcaccagcggcttcatttgcggaacgtcaatcagcgccgccagtttatgtttactgcggtggctataaagataatcaaacagtcgcggctggcgtgttttcaccagttgcgccatcgcaatagtggcgtagacatccgccatcgcatcatgcgcgttgctgtgttcgatcccgttcgcctgggttaaatgttccagacgaaagctgggcaggccgtcgtcgttttccggccagttaattccctccgggcgcagcgcataacaggcgcgcatgacatccaatagatcccaacgtgaattatcatgctgccagctccaggcgtagggatcgtaaaagttgcgataaaaaatattgcgcgtgacttcatcatcaaaacgtacattgttgtagcccacaacgcaggttttaggaacggtaaacagcgcatgaatgcgtctggcgaaagcggcttcgttttctcctttctcacgcgcttcctgcggcgtgatgccggtaatcagcactgcgccgggctgcggtagataatcatcggcgggtttgcaataaaacacctccggctcgccaataacgttgaagtcgttatccgtacggagcgcggcgaattgcgcaggtctgtcgagggccggatgcgtaccgaaggtttcgtaatcgtggaagaggaatgtgctctgtatgctgtcgtttttaactgtcacttgatgtacacgcctgatgttatctgtatatgaaatattttattcttttattttgtcgttgattgattgtatttgtacaccaattgatattgttgctaatgttcgtacatgcgatggtgagtacataaacattaaaatcattgagtacaaaatactaaaatgaccatcagcgacactaagctacgctccctctatggtaaaccatattccggcccatctgaaattactgattttgatttagtactgtatggaatttaggccagggtcaatctggccgggatctcaaaaaatgcatggactaaaacgggtctatgtacagagggacacaacgctgtgtcccttaatttcatgcgggttgaggctggactaggcccaggccagtggcaggatggatgacagaacactcgggaaatattttctggcatgacgttgcatactatccaccacaacgctggtacaggtaaaggcgccatggaggccgtgaaaacggtcggaccagtcggtaaactgttcgctggacgggaagatcgccggagacagctcccagtctttctgcatcagcgcctccgcatagcctctcagggccggcggagagtcatgctcagtgccgaaaatggcgctggaggaatagcgtgcgaatgcggtactaagacagaacagggtttccgcctgcttctgtggggtggcgtccgtcaggtgataagcactgaggatgtgctggtagtgtgccgggctgagtttgccttcaggaagcagggggtcaaaaatggtgttcagacgcgacactgaggcatcatcaatcaacttcacggtggaatgtttctgggtcgtggcggcaataaactgctggttcagctccccgtgctcttcagcgctgaggatgatatcaatcagttccccaaagcgtcgctgcacggcctgctgattaaatgcggcgagaaacaccggaaagtcatgacggaataactctaccggagagatttgcgcggtggaaacgttctctccggctcgcagcaggtaaaagttgtcccatgcagtgtcaggagtagggtttagcattgttaacagcgtgtcagtggagagcatcatcgccgtgtctgaatcctgggaggaaagcagcaggaaattatctgcagcgcgggttgtccagtccgggctgccgtcataattgccgaagagcccattatggatgtggggagacaccgttgggtgagcaagatatcgttcataaagcgctgcagctttctggcgggtgccatcagtgcagcccacgcctgtcatacagtgtaaaatcacctgattaaagagtccgttgtgagtggtcatggcggcgttgttcctgtcaaacgaatccagcaacacaggccgtatgcgctgctgataatatgtgtcaggagccggcaggggaacgtcattataggtctggcactggtgggcaaaaaaacgttcctgaacaggcccgagccactcgctgataagcgtactttgcgtatagggggggccagtacgctcaccagcgaactttcaactggccggatacatgcctctgttaagcggccactccgcaatgacttaaccaggtcttccattgcccggactttttcctgactgtatttatcgggcaggctgtcaatggttatcagaatacttttaccattattgtgctcatgatttaaaaatccatccacagcgttctcagtccaaaggagtggcatttgcggccagatatcacctggacgaataaaattttcgccccctgatactgacggaggtgatgaattatccggttcatttaaaataacgccagagaggttggctttgtgacgtataagcgtattttttaatgttgtatcaataaaagagggctgttgttgtgtagtaattgaatactgtaaaacacttcattcatgtctgaattactaaattttgtattactgcagactacatcactcagtgtcaaataagtgaatcggcattcgtcaaaatgtaaatgagatatatcagaataagtaaattttgaatttgaaaagttgaacctcttaataatatcgccgtctcgctccatgaagctgaggggcaatattttgctgaatgtaatattacggaaatctgcgtttgaaaaatcgcgatctgcgggcgtaagagtttctccggctttctgccgtaaaactgcatccgtaagtttcttagcccagtcggcaggtgatgacggggaagacgtagcctgaagtgagagggagggtgatactggtggtgttctaccttcagaaaccgttggcctgttattggctgatacagagacttcaccggggagcggggctgcacctgtcactctgtaattataatcacatgattgatttgcaatatgcttacgcatgagtgctgcagtcatttttgagacatcttcttctgaaatatttttcttatatgtattatttgtatctttaatatttttaacagtaagcaatgtattgtttaaggtattttttctttcggctgaaagaattcttttattttttgtggtagcgatatctcaatcggtgagtcctttcatgttttaaatttttcatttaaagatgcatgcgtatttttaacactggttatttttgaggcgagcccgtttttcgtatgttcacggatggtgttaattaattttttaacctggttaggaatagtagaaaaattaattgcgcctgatgatatcttcattagaattccttatcaacatcattatggaaaaacggtctggatttttaacgccttaaaagtaagctccatatgtcggtatggcgttggagatcacaattcaccatgctatctggcatgtttctttcagaaagtgtccatcctgtcatcatgtcaccgtattgtgggacgctggcgtatctgcggaaaaatccaggcataagagagcgggtcgggtaacggagcccgtatgcacgcaaaaataaacccgcttcgacgctcaaccagcgtttttcgccggcattcgggatatcgtcggcggacgttccggcgagtatgaaaaagaactgcgtaaagcgcgtgaaatcgcttttcaggaaataatcgttttcttttaaatattattacgtgttattggaattgtatcatttttataattaacagtgggttgtttggtaattctgctgattattcgatgacagtccatgtgcgtgttcaggaaatgtaaaatatttataaaataaaaggttttatcatgttggcatgctcatattaacaactatttcaaattgtgattgaagccgacatttcataatacaaattaaatataatcttcagctatatctaataacaggaggttatatgagcattagtcgtcgttcttttttgcagggggtaggcataggctgctctgcctgcgcgctgggcgcttttccgcccggggcgctggcgcgcaacccgattgccggcattaacggtaaaaccacgctaacgccaagtttgtgcgaaatgtgttcctttcgttgccctattcaggcgcaggtagtcaataacaagaccgtttttatccagggcaatccttctgcgccgcagcaggggacgcgcatatgcgccaggggcgggagcggcgtcagcctggtcaatgacccgcaacggattgtaaaacctatgaaacgcaccgggccacgcggtgacggtgaatggcaggtgattagctggcaacaggcttaccaggaaatcgcggcgaaaatgaatgccatcaaagcgcagcatggccccgagagcgtggctttctcttccaaatcgggctcgctctccagccatcttttccatctggctacggcctttggttcgcctaatacctttactcacgcctcaacatgccctgccgggaaagccattgcggcaaaagtgatgatgggcggcgatctggcgatggatatcgctaacacgcgctatctggtttcgtttggccacaatttgtatgaagggattgaagttgccgatacccatgagttaatgaccgcgcaggagaagggggccaaaatggtgagcttcgatccgcgtttgtcgatattttccagcaaggcggatgagtggcacgctattcgtcccggaggggatttagcggttctgctggcgatgtgccacgtcatgattgatgaacaactctacgatgcgtcttttgttgagcgttataccagcggatttgaacagttagcacaggcggtaaaagagacgacgtcggaatgggccgccgcgcaggccgatgtcccagccgacgtcattgtccgggtgacacgcgaactggccgcctgtgcgcctcacgctattgtcagtcctggtcatcgcgcgacgttctcgcaggaagagatcgatatgcggcgtatgatttttacgcttaatgtgctgctcggtaatattgagcgcgaaggcgggctatatcagaaaaaaaacgcgtcggtttacaacaaactggccggagaaaaggtcgcgccaacgctggcgaaactcaacattaaaaatatgccgaaaccgacggcgcaacgaatcgatctggtcgcacctcagtttaaatatatcgccgctggcggcggcgtggtgcaaagcattattgacgcggcgttaacccagaagccttacccgataaaggcgtggattatgtcgcggcataatcctttccagaccgtcacctgtcgttcggacctggtaaaaaccgttgagcaactggatctggtggtcagctgcgatgtctatttgagcgagagcgcggcatatgccgactatctgctgccggaatgcacctatctcgaacgggacgaagaggtatccgatatgtcgggtctgcacccggcttacgctctgcgccaacaggtcgtagagccgattggcgaggcgcgtccgagttggcaaatctggaaagaacttggcgagcagttgggattagggcagtactatccgtggcaggatatgcagacgcgccaactctatcagttgaacggcgaccatgccttagcgaaggaactgcgacagaaagggtatctcgaatggggcgttccgctgctattacgcgaaccagaatccgttcgtcagtttacggcgcgttaccccggcgctatcgcgacggacagtgacaacacctatggcgaacagcttcgcttcaaatcgccctccggcaaaatcgaactttattccgcaaccctggaggaattgctccctggctacggcgttccgcgcgttcgtgactttgcgctgaaaaaagagaatgagctttacttcattcaaggcaaggtggccgtgcataccaatggcgcgacgcagtacgtacctttactcagcgagctaatgtgggataacgcggtctgggtccatccgcaaacagcgcaagaaaaaggcattaagaccggcgatgagatctggctggaaaatgccacgggtaaagagaaaggtaaggcgctggtgacgcccggtattcgcccggatacgctttttgtctatatgggatttggcgctaaagctggggctaaaacggcggcgacgacacacggtatccactctggcaatttactgccgcacgtgacgagtccggtatccggtacggtagtgcataccgcaggcgtgacgctgagccgggcatgagggaggagggaaccatgaatcatttaacgaatcagtacgtcatgctgcatgatgaaaaacgttgtatcggctgccaggcgtgtaccgttgcctgcaaagtgcttaatgacgtaccggagggatttagccgcgtacaggtacaaattcgcgcccctgaacaggcatccaacgcactaacccattttcaatttgtccgcgtctcctgtcagcactgtgaaaatgcgccatgtgtcagcgtttgtcctaccggagcgtcatatcgtgatgaaaacgggatcgtgcaggtggataaatcgcgctgtattggctgcgattattgtgttgccgcgtgtcctttccatgtgcgctatctgaatccgcaaaccggcgtcgccgacaagtgtaacttctgtgccgacacgcggttggcggctggccagtctccggcgtgcgtatccgtttgcccaacggacgcgctgaaattcggcagactggatgagagcgagatccagcgctgggtcggtcagaaagaggtctatcgccagcaggaagcgcgtagcggcgcggtcagtctgtaccgtcgtaaagaagtccatcaggagggtaaagcatgaatactatctggggagcggaactacattatgcgccagattattggccgctgtggttaatttacgcaggcgtcgtggtgctgctcatgcttgttgggctggttatccatgcgttattgcgccggatgctggcgccaaaaacggcgggcggcgaagagcatcgtgactatctctactcgctggcgattcgccgttggcattggggaaatgcattactgtttgttttattactgttaagcggtttatttggtcatttttctctcggccctgtagcgctaatggtacaagtgcatacctggtgtggttttgccttactggctttctgggtcgggtttgtgctgatcaacctcaccacaggtaacgggcgtcactatcgggtaaatttttccggactagtgacgcgctgcatacgccagacccgtttttacctttttggcatcatgaaaggggaagcgcatccgttcgcggcaacagagcagaataagttcaatccactgcagcaactggcatatctggcgattatgtacgcgctggtaccgctgttaatcatcaccggtttgctgtgtctctatccgcaggttgcgggtctgggccctgtgatgctggtgctgcatatggcgcttgctatcatcggcttactgtttatttgcgcgcatctctatctgtgtactcttggcgacacgccgggacaaattttccgtagcatggttgacggctatcatcgtcatcgtaccgcgccgcgcggggataagtccgccgtctgagcgtatccataaaataaagtcagcaagaaaatgtgccttgtgtcacattttcttgcaatttatccatgtttgtttaactgaacttccgtaaaaagaacggcaaattgagaccatcctgaagacatgctgttgaaacgccgtttgtttattgccgcttctttattcgcgatgcacctttctcctgcgcttgcggccgatgccgtaagttttgctccccaaccgccagccattgatgcaggcgcctgggtgttgatggattacactacgggacaggttcttaccgccggtaatgaacaccagcaacgtaatcccgccagccttaccaagctaatgacgggctacgtcgtcgatcgcgccatcgatagtcatcgtatcagccctgacgatatcgtcaccgttgggcgcgacgcctgggcgaaggataatccggtgtttgtcggctcctcgttgatgtttttaaaagaaggggatcgcgtgtcggtacgcgatttaagccgtggcttaattgtggattccggtaacgatgcctgtgtggcgctggcggattatatcgcgggcgggcagccgcagtttgtggcgatgatgaacagctatgtgaaaaaactcaatttgcaggatacccattttgaaaccgtccacggtctggatgcgccgggacaacatagctccgcgtatgatctggccgtactctcccgggcgattattcacggcgaacctgaattttatcacatgtacagcgagaaaagcctgacctggaacggcatcacacagcagaaccgcaacggcttgttatgggataagaccatgcatatcgatgggcttaaaaccggacacacatcgggggcgggatttaatcttatcgcatcggcggtggacgggcagcgtcgacttatcgccgtcgtgatgggagcgaaaagttcgaaaggacgcgaggaacaggcgcgaaaactgttgcagtggggccagcaaaactttgcgacggtgcagattttgcacagcggcaaaaaagtgggcagcgagcggatctggtacggagacaaagaaaagattgcgctgggtacggaacaggatttctgaatggcgctgcccaaagcggaaattccgcatatcaaagcaaaatatgtgctggatagaaaagagctggaggcgccaatcgccgcccatcaacgggtaggtgaaatagagctctacgatcgggataaactgatcgctcagtggccgctggtcactctggaatcggtgggtaaaggcggtatgttctctcgtctgagcgactattttcagcataaagcgtaagccgttgtcacacaccgttcaccgtcatctgaggtgtcaaaagggcgggattgcgaggttgctcacaaaatgatcacgctgtccttgtgaccgtaaaaggctgtaattatactgtacattaatacagtatagtaaagtgacggaggcagcatggattacgaaatcaggcaggaacaaaaacgcaagatagccggtttccacatggtcggtccatgggaacacaccgtgaagcagggttttgaacaactgatgacgtgggtggatcgacagcggatcgtgccagttgaatggattgccgtctattacgacaatccagatgtcgtacctgcagaaaaactccgctgcgataccgtggtgtccgtggcagagaatttcatcctgccggacaatagcgaaggcgtaatcgtgaccgccattgaaggcggcgaatatgccactgctgtcgcgcgagtggaagaccgtgactttgcgaagccgtgggaacggttttttgatgtcctcgagcaggatagcgcttatcagatagcctctgcgccctgttttgaaacctatctgaataacggcatggaagatggatactgggatattgaaatgtatattccggtacagcggaagtgatcgactggtttcctggctgaaaagagcggacggataatgtgttccgtccgccagtgcgctatttttgctataaagcaggtacaatgcattttttgccattcccgtaaggagcgcaagcgtgcgtgccgataagtcattaagcccttttgaaatacggttgtaccgtcattatcgcatcgtgcatggcatacgtatcgccctggcgttcattcttacctttctgctggttcgtctgttttctattcccgagggcacatggccgctaatcacgttagtggtgattatggggcccatctcattctggggaaatgtagtgcctcgtgcttttgagcgcataggcggtacgattctgggcgcggcgttagggctggtggcgctacgcctggagctcttttccttaccgctgatgctggtgtggtgtgcgatagcgatgtttttgtgcggctggctggccttagggaaaaaaccgtatcaggcgctactgataggcataacgctcgccgttgttgtcggcgctcccgctggtgatatgaatacggcattatggcgtggcggggatgtgattttgggggcgctactggcaatgttgtttaccggcatctggccccagcgcgcctttttgcactggcgcatccaactggcgcattgcgtcacggcgtataatcgggtgtatcaggcagcgctgtcgccgaatttgctggagcgcccccggttggataaatatttgcaacggttgctgaacgatgtcgtcaaaatgcgcgggctgataacgccagccagtaaagaaacccggatacaaaaatctattttcgaggccattcagaccatcaaccgcaatctggtttgtatgcttgaattacaaatcaatgcccactgggcgacgcgcgccagccattttgtgatgcttaacacgcacacattgcgtgaaacccagcagatgacgcagcaaaccttgctaacgatcgcccacgcgttgtttgaaggcaacccgcagccggtactagcaaataccggtaaactgaatgatattgctgccgagttgcgacagctaatgaacgagcagcagggcgacgcggtggctgaaacccccatccacggctatgtttggctaagtatggaaacggcccgacagttggaactgctttcacacttgatctgccgggctttgcgcaaataaaaagcagatggggtgaatgaatttgttgctgcttcgattcagcaaagattaagagtatgatactaatataaggataaaatgagtgctactggcaacgattttatccccgaaccttcaggtttccccagacggcgacgtaacggtgtttcttctggcggcttgaagtatgacggggataaacgtaatgtttatccactagcagttgcttaacgaatccgaatctcacattatcaggggtgtaaaaatggaaacaaccaagccttctttccaggacgtgctggagtttgttcgtctgttccgtcgcaaaaataaactgcagcgtgaaattcaggacattgagaagaagatccgtgacaaccagaagcgtgtgctgctgctggacaacctgagcgactacatcaagccaggtatgagcgttgaggcgattcagggtatcatcgccagtatgaaaagcgactatgaagatcgcgttgatgactacatcattaaaaatgccgaaatctccaaagagcgtcgcgacatttccaaaaagctgaaagcgatgggcgaaatgaaacacgccgatgtaaaagccgaataatgcgctacggcagtgggagcgtatatcaggctctcactgcagtttgaccccgcctgtgaccatcttgagtaaatgttgttttggccagtgtcgggtaagttttttctctgccagcttacctttcagacgcgcaatatcatgacgtttccggtccagcatcagacccaccacgctaccgctatgcgccacgttcaatccgtataaatcacactcttcgaccagcgacagcagggcggtaaagcccgacttaggtaacagcgtctggctggcgatagcgctaagcgtagccgcctcacccagtcggagcggattttgcgttatacaggcttcctgcaccagattccaggcctgctgcaaggttggtgaacttgctattaatttctgctggcgagggagacggtggtaatcttgcgtgcgcagtgtgaccgggctttccagtaccagcaaatcgattggcggcggtggctcgcaggcgatttgcgtggccgcattattatgatcaaacagcgttaactgatgaaaaacggtgctatcagtgggttcgattgagacgcaaagctgtgcaagggtggtttcatccagcgaatggccaagatgatgcgccgttgccaccgccgtagcggcaatatctgcggtgctgctggccatgcctttggcaacgggaattgacgaacgcacatcgacgcgaatctcgttactccagtgcgcaggatactgccagtgcgccagaacgcgctccaccatcgcccgcgacaatggacgctcgtttaccaacggcggcgcagccgtgactgctacggtgctgtaccagtcaacggggcaggagaccagtttctcactgcccagaatccatccctggataagttccccgcatgaggcggggcattgcgcaacagccacgttatcacctttcaggtacgaatagtgtgcgcgcatagtgtcatggtaaaagcgttattaccatgacttgccgcaatgcgtcgtatacccctctcaggctggtacacaaagcccttccgtggccggtagcgcaatgcgcataacgtcttgtgcgatcattaactcttcgttggtgttgatgacggcgactttcaccagggcgttctccgtctggataaatgttgcattacgttgatttttctcttcatcaacggctaagcctaaaaattgcaaattatggcaaaccgccgatctggcgcgcgctgagttctcgccaattcccccagtgaataccagagcatccagtcctcccatttgcataatatagccaccaatggtggcgcgaatgcgttcggcaaacagcgtgagagcgagtttagcctgccggttaccggtattggctgcctgttcgacatcgcggtaatcagacgacacgccagaaacgcccagcaagcctgactcattatttaataactgattcaactgttgcggcgttttgcattcgcgctgggctatccacggcagaatagagggatcaatatctccgctacgggtgcccatcatcacgcctgactgcggcgtaaagcccatcgacgtattgaccgaacgtccgttcttgatggcgcagacgctgctaccgtttccaagatgacaacaaatcacccgtaatgcgctgagtggtacgcccagcttttcagccagaacgccgctgacatacttatggctggtgccatgaaagccataacggcgaatccccagttcagcgtaataatgccagggaagcgggtaaatataggcgggttcatccagcgtctggtgaaatgccgtatcaaacacggctacagaaggggcatcaggcaacagttgacgaaaaacgtgaatacccaacgcgtttaccgggttgtgaagcggggccagttcagcaagacgttcgatttgcgctaacgtttcatccgtgaccagcgtcgagtctttaaaaaactcaccgccgtgcgccacacgatggcccaccccgtcaatgtcccgcagactgttaatgatttgataacccagcagcttttccagaagcagcgttaccgcatcgcgatgatcggcaacggggacggtttcctgccatttttggctgtgcgtcttaattgtcacctgcgcatccgccataccgatacgctcaatcagcccctggcagagcatgtcgccctgcggcatctccagcagctggaactttaacgatgagctgccggcgttaatggccattattttgtaagacataaaggttccttcgaattcagaaaatccagcacggcgtcgagacccgaattattcaacgcgctggtaataaaaatctgccgggcgccagcctgcgtaagccattgtgcgaccagcgaaatacgctgcgggtcggcgagatcggctttggtgacaaggccaatcgtcgggcggttcatcgggacggtaaaacccggagaaaacggcgaccactgagcgtcggcatttaacaccagggcgataacgtcggcctcgcaggcgctggtcagcagggcgctgtacaggcagcggttctccaggtattcgcccggcgtgtcgatagccatcggcgaccattcaatggcctgggttttcttgtaatggagcgcttcgccacgcaggctttgggtcagcgaagttttcccgcactggctggggccgataaacatcagacgcttcattggattacgtccgggtgatcgagcaggtagtgaactgcatcatctcgcccagggtgcgcgttacctgcttgagggcatattccacggcggaaacatcgccggtcagcaccacagcaccggtaaagcggtcaagaaaaccaatctccaccgcgccggattttgtagcaatatcgcaggcgataatcgacgcttcgctgggcgtgatggtgaggatgccaatggcggaaaccgcatcctgcaggcccagcttcttaaataaatctttccccggattagcaatcaggtgcgcgagggtcacctgtttccccggcacgtattcctgaatcatgcgatccgttgtcggttgtctttccattatccctccaccatctgtcgccacatggcttcatgcgagcgtgggatcaccgaacggtaaaccagcagccctttttcgcccgcgctttcgctggcgaccgtcacggcgttattgacgtcagaaacgtcgcccgccaccaccatgtagcatttaccgccgatgccgaaggccatatgcacccgcaccagggtgacgtttgagcctttcaccgcccggtctgcggcgctaatgcaggccgccacgctccaggtttcgacgatgccgaccgcctgacgcttatcgacgctgttcaggccgctgatggccggaagtacgctgggatgaatatttgccagcaccaggctgtcgacgagcatctcgccggcctgcgacgtaccggtttcaatggcctgctggatagcgccgatatcgccgcccagcatcagtaaaaacttacttgggcagatggtcttgctgaccagtagatcgacgttggcgcttttcagcatggcatcaccaagctccatgcctttggcgatgctggtgagttctaaaattcctatagcctgagacatggttaacctcttacaacagtgatggcctgttcgctgatggccgaaacaatgccgtcgatgctggcgtgaatggatgcgccgagcgcgccaggcgggacatcggcaacgcattgcccgcgagtcacgcgctcgccgacggcaacagtcggtactgcgctggcaccaatatgctggcgcagctgcaaagtgactttttctactgacggctcttcttcaaccagcggcgcttcctggtaccaggggcttagtcccagtttggcgatcagccgcttcaccggcaccaggcgatatttcgccatttcgtcggccggattcagcggcccttcgtagcgctggttttgcgcccgcagctcgcgttttaacatgcggttgatgcgcatcggcgagatcccgaccgggcaggccacgctttcgcaaacgttgcattccgagcaggtaagggcgctcagcagcagttgcggcgtggcagcctgatgaaagttcaccgcccgcaccagcaggtgcggagagagttcgtggccgatcagatgtcgtgggcagagatcggtacagagtcggcactgttcgcagacggtgcgcgcgacggaaagcactgtgcgctcgtcctgcatcctgcgctggataagcggatggctttttgggagcaccagcaggccgccggtagttttcgtcaccgggttatcaagagaggtaatcaggccacccatcatcgggccgccgttaataaaaccggggttgtcgaccgtcgcgccgccagccagcgccagcacttcatgcagtgacatgccgacaggaacggtaacggtcaacggtctggcgaccgcgccgttcacggtcaacgtgcgacgagtgaccggaaactgctgctcgaccgcccgggcaatattcagcaccgtttgcacgttattgacgactacgccgacgctggcaggcagcgcggcaggggcgacccgacgaccggttgccatccagatagtcagcacctcatcgcccgcgggatatacatccggcaggatatgcaggcggataccggctggcagtagtggggagagggcgtcgatggcccggcggtatttttctttcagggcaatcaccccttcgcgcgcgccggttgccgtcatggcgtactgcacgccgcggacaagacgcgcggcctgctgccacatcagttgctggtcaactttgagcatcggttcacactcggcggcgttcaccagaaaaatctctacctgcgcctgtagcttaacgtgggcgggaaaacctgcgccgcccgcaccgacaacgcccgctgcgcgaacgcgctcacgaatttcatcggcgctaagggacatttaaacgctgttgatggcggcgctcatagcagttcctccagcagttcacgaatttcctcggcgctggccgggcgcgggttggtgcgcaacgtgacatccgccagcgcggcctgcaccatcgctggaatacgtgcggaaaagtcggatcttccttcttttagcgcaacggccagtgagggaagggcacagcgttgcttaagcagttcgatttgctgaatcagcgcattgatcgccgtgacatcgttggcttctgccgggcaaaaaccgcaggctttggccagccgcgcgtagcgtttggctgcgcgcggaactccggcgttaaaacggatcaccgtcgtgagcagcagcgcattggccaggccatgcggaagatgaaactgtccgccaagctggtgggctatcgcgtggttaagccccagccccgcctggctgaaggccatcccggcgagcgttgaggcgttatgcatttttcctcgcgtcgccacgcagtcgcctttttccaccgccgtcggcagatactggaacaccagtttggcggctttttccgccagcgcgtcggtaaagtcgctggcgtgcggtgacacccaggcctccagggcgtgggtcagcacgtccatgccggtgttggcggtaatctgcggcggtacgctgaccaccagctccgggtcgaggatcgccatatccggatacagcgcattgttgaacagcggatacttgatgcctttatccggatcgctaattacgcaggcgctggtgacttccgaaccagtgccgctggtggtcgggatcgccacgcaggtttcgatattgatgccgctttgttggctaaaccagacaatcgctttcgccgcgtccattgccgagccgccgccaaaaccaatcaccacctgcggctgcagggcctgcatttgcgcaatgccctgcaccacggtatggatggtggggtccggcgttatctcgctaaagacgctgatgcggttatctgcgggcagcgcgttacacagggtatccagcagcggcgagcgtgccagaaagccatcgcagattatccagatgtgcttattggtaaagcgcttgagcaccgccaggctgccctgaccgctgtacaaccgcgtttgtagtgagaaggtgttcatcgcgacctcggttagcgaatagaaaagccgttggtcagcacgcagcgccgggagcgggcaaaagtacgcgctgacgttgttccttcaccggttggcgtggcaatggtaaaggtggtaaagccttcgccgccgacgccgatcccggcataagaagggccgtttttgacgaatatcgaggtttgcagggtgcgggccgcgaggttcaggcgcgacacgttctgcgagtgcatgatcgcggtgtgatgcaacccctcttcaaccttcagggccagtgccagcgcgctatcgaaatcgttaacttttaccaccggcagcatcggcatcagctgttctctggtgacccacggatcgtcagcgttaaccagcgcaatcagcagacgcggcgcttttgcagggacagcgatcccggcggcttccagcatggccgatgggctcttgccgaccagttttttattcgcctggccttcaggcaggcagacggcgcggagtttgtcggtatcggcagggcttagcagcagcgcgccgaaggtttgcatttgctgcaccagacgttcggcgacgctctccaccacgatcaggctcttctcggcaatgcagggcaggttgtaatcgaatgacgcgccgttgatgatatcttccgccgctttcaccaggtccgctgtttcatcaacgatgcagggcggattgccagcgccagcgccaatcaccttcttaccgctcttcatgcccatggccacaatgccggggccgccggtaatagccagtaccgcgattcgcgggtgggccatcatctgctgggtcgcttcgaaagtcggttccgccacggtcaccaccagattgcggatgccgcagcagcggaaggcaatctcttcaatcagactaatcagcttcagagagacctttttcgctcccggatgcgggctaaagtagatactattgcccgccgccaacatgctgatgctgttattaatgatggtttccgtcgggttggtgcttggggcgactgaaccgatgacgccaaacggcgagtattcaaagagtaccatgccgccgtcaccggtcagcgcggtggtggtgagatcttctacgcccggcgtgttgtccagagcagccttgtttttgaggaatttatcttctttgttgcccattcccgtttcattggcgctctcctctgccagagcagccagcagcggcgtcagctcctgacgcatcgcgctgataatggcgctgcgggtttttagcgggcactgctgataacgtaagaacgcctgatgcgcggcgtcgatggcctcgctcacggactggaaaatccctttgccctgaggctgggccggtgtttgcgctggcgtggttaattgctcgctaagaatggtgcgaatcagggtttcgagttcagaagtattcattgatgtgttcccacgttaatagccgcgatggcggtctgtgctatgtccatgtcctgctcaacgctgccgccactgatgccaagacccccaattaatatgccgtcgcgccatagggcgtaaccgccgccaaaggtgaccacttttccctgtaaatgactttccagaccgtaaagcgccgcgcctggctgaacgacatcgctcagctcatgggtcgccgttttcatcgccactgcggtccatgcctttttcggtgccagttcgctgctgaccagcagggcgtccggcatccgccaggtcacagtttccgtgccgtgcgcgtcaacgatgctgacgactaccggaacctgcagttgctgcgcgcgttcaacggcggcgcgggtgagctggtgcagatcgtggaatgagagggccacgggcgttgtctccttgctgcgggtcggctggctggcagccagatagcgcttgctaacttcacggatgatgttggcctggtgcgcatcgctatcttccgcgcgggccagggcgtacaggcagtccgataagcggttgatgtagcgcatcagcacttggcgtacgttgacttcagttgccagttcaaccagacggcgttcggcgcggcgcgccagcgtgcgggcaaaatgtaatcggctcgcggcttcgcagcgtccgggtaaaataaagctgtgcagcggttcgacgcgggccattgcccgatcgatagcggcttccagggccgaaatctcttcgctgctgatgtagcgctgtttgggcgatggctgctcgctgtcgctggccagctctgcgctaaaccaaaaaagttgctgctggatggcctcgagtaaggtgcggtgattttcatccgcagcggcgcaggcgcacaggctcagcgcggcgttcagttcatccagcgtgccgtaggcttcaacccgcgggtgggttttgctcacccgctggccggtaaacagtgatgtggtgccagcgtcacctgttcgggtataaatcgccataaccgccccttaacgcgaaagcgtatctacaatgccgacaacggcgaggtcgatggcctcatttggcccggaaaaaacgtgcctggcgctggagccgccgctgagcaaaaccagttcgccgacgcccgcgccgacggagtccacggccacttcatcgccggaggtgggcgaggcggggagttcgccatcggcgctgacccgacgcaccagcagcagcttttcccaatcaaagaaggtgatttttgcgtggagacaaccgcgcccgtgactcgtgccagatgcatgatttactcctgcttaattaattgaatattccgcgcattggccgcgtcacgcgccatggcggtcacgatgcatttgcggtggacaaccacacgcccccggcttagcagcgcgacatcgcgatagcccagcaccgaacccgcatgcagaaccagcggcagtccgtgctcgtcggtgaataccagcggcagacgagccagtttttttaccgggataaccggcagcagctggctgtgcaggctgagctgtacgcggatgccaaacgccagcgcgtcgtgaattttccgggctgcggcatcgtcggtttctgcatccgcaagctgacccagcagcggcaggtcgacgagcaggatgcgcagcgacgcgtgctgacagaacagcgctggacagtcggcatcgcgaagctgcgcaacgctcagcgttgccgtgctcagggcacgacgctgcagtcgggagacaatctcctcgacaatgcgctgcagagtttcgccgttcatcgcgggcctaccagccgggcaaaggcctgcgggttatcggcaccagcggcgttggcttcatcggtatcaatgtgcatttcgaggcgcatgtccggtgaaacgcgaatcgccacattgttgaaaatcagcccgcgctcgtcgccttcaatcgctaccgaaaccctatcgccgtgggagaccttcaggatcagcgcatcaagcggcgacatatgaatatgccgctgcgcgacgataaccccggaaggtagctccagttcgccaaaggggctgaccaggcggatgccaggtgtgcccttcaggttgccggacattctcagcggcgcggcaatccccagtgttctggcatcggtacgcgatatttctacctggcttaccgagcgcagcgggccgagcaggcgcacatttttgagctgtcctttcggccctaccagggtgacggtttgctccgtagcatattgtcccggctgcagtagcgcttttttttcgctgatgggatggccgggaaacagccgctcataatcctgcgcggacaggtggatatgacggtttgagacgcccagcggaataggccgctggcgcatctcgtcgagaactttacggaccgttgattgcagaagctctttatccattacgcttcacctcgcttgccggaatgaatgcaaagcgtacgaggttcgcccttctggcgcggacattttggatccagacacagattgcagctgaccagttctgattcctgcggggcctcttcggctggcgcttcagaaacgacatcagctatctctgacgcttcaggctcaggttcaatgacggagggggagggtgtctctgcgagcaggatcccttctccgggcctggcgataaccttgtgggccaccagaccattccgctgttcggcaaattgcgcaccggtggtgatggccgcctgcacggaggccacatcaccggcaattttaatcaccatccagcctgaaccattggtcttttcgagggcgagcagcgtgatagaagcggatttcgccatgatatcggcgcagctgatagccagtgccagaccacaaacttcaagtaatcccagtgattgcttcacgcggtgctccttattcgccatcgattaggctgatttcggtaaaatggcctcaacatcgctgtgcggacgcgggataacgtggcaggatttcacttcacccacgacgcttgccgccgcgctgccggcatctacggctgctttaaccgcgccgacgtcgccgcgaaccatgactgtaaccaggccagaaccaattttttcgtagcccaccagctgtacgttggcggatttaaccatggcgtcggcagcttcaatggcgcctactaacccttttgtttcaaccagtcccagtgcgttattcatactgcagttctcctgttgcttagctattcagatcccggaaagggatccctttgaccagccgtgccgcgttattaccggtgttgcgttgggcctgactgtcctgatgatgcatcagcgtaaaaagcggcgccgatgcgggtaaattcttgtaatgtacgaccagcgagtgtcgatcgcaggcaatgccgaccagcagcggcgagctgcgcgccgcctgccaggcgctgtcaacgacatctccagctgggtgatgctgaagcaggaaagggatgccttcctcttcaatgcccagcagcacttcgtgccagaggctggcgcagtcgttgatgacggtaatgacgatagccggggcgctgtgattactgtccatatgcaaactccttgtgccaggagagaatcagaccggtggccaccgcgtttcttgggccttcgctgccgcgaatatttcctcgcccggcgactaggcggtagtgcgccagcgcatcggtgaccaactgcggaacttcgaaatccagcgacgagccgccgaccagcaccacgaacggaatatcgcgaatgttgccggttggactgacctgacgcagcgcgcgcagggcgttggtgacaaagacgcgttctttagcgctgcggcgaatggcgcgcactttttccagcgctaagtcgccgggaagcggcaccagttcgtccggtttcaccacgcagacgcgggcgaacaccgcaggaggcagcggcgtcgggaagaactggacgctgccgtcctcgtggcgtaagtggaacaggctttcgaccttagccagcgggtattttttgatctcttccgccagatagcggtcttccagccccagttcgcgggcaataatcatcgtgaccatgtcgcctgccccggcgagatgggtggcgatgatttcacctttagggttgatgatggaggcatcggtggagcccgcgccgaggtcgaggatcgccagcggtcgggtggtacccggcgtggtcagcgcgcccagaatggcggcttcagcctcagcgccgccgatctgcacgtcgatattaagcttctgctcaatttcacgggcaatcatcgccatttgcagacggtctgatttcaccatcgaggcgatgccgacggcctgctccagcgagaactccccggccagaccgccggtgacgctcaccggaaccgaggtgtcaacggccagaagatcctgaatgaaaatctcgctgctcggcttattggttagctcggccatggtctggcgcacatgctccagcatgccgccgatattggtcccggcctcgccgttgacgttgtcgagcttgccgtagccgtccaccgctttcatgatagcttcggcaccggcggcaacatccacgcgcacggtacgaccctgagcctgcagctccaggttaccggcgggtattgcgcgcgctttgacgtcgccggatggcgttttaaccaccacggcggaacggttgccaatcagcgcgcgcgccatcgggacgatgtttttcgtctcatcggcgttgaggttgaatacggtggcgatgccgtaagggttagagagggtttcgataacctttcccggcacggcgacttcaatcgccgccagcatccccagcggaatgcagtcgatgtacagaacttcatcgacaatcggtagcgatttttccagccggttgctgaccagtacgccatcgtcgcgctgcaaaatgacgccggtaatctggtatccggcgcgcattgaggcgttgataacattggcgatatcagcaaaatcaaaggctgacgataccaccagaatataggacgagtccgccgggcgggttaacagctcctccggcgtaatcgtgatacccacaccaaggcctgctccgcccggcgtttttgggttatggccgatcattgtcgattcggtgatgatggtttcggtaatggtttccatcgccacatcgccaatcaccggcgtggcttcgttaatgcggatgagcgaaatatcgctgacattgatccccgcgcgctttgcgacgagggcgagcgcttcctgaatgccgaacacgttacgcaacgtgcctttgatcccggtgttttccgccagcgcgctgtgtgtaatcgttagtgcgccagtctcatcttgccgcgccagtgcgacttccgttgatgagttaccgatgtcaatgccagctatatatcgcatcgtatatcctttttctcgtcgtacttcaaactgcctttttgttggctgcgttctttcacccgaatcacttactacagtaagctcatcggggttatgagggacatccctgtccctcactaaagccagcctatggctgttcaaattcgttccagacgaatttgtcactcacttgccgcctcaatgcatctcgaattacttagagaaagctaatcgtcgcctttgagttttttacgctcaacgtacagccctgccgcttcacgaacgaaagctgcgcaaatctttgcctgataacggttttcgagatcgtcggcgatagcgagcagctcttctttcgttgaacgatacggacgaagggcgttgtagatttcaagaatgcgatcgtccggtaccgcggtcagttcggcggcgcgttcgaagttcatcgccagccggtcgcggcccgcatctttggcgatagacgcctgtaagcgcagggttttcggggtaatacgcatatcctgagcggtgactttattgctcagcacgttttccagcgtaaagtcgtccagcgttttattggtggcggttttcacccattccgggtgtttgttcgccagcgggtagtcgctgacctttgcgctgcgggacgtgccgcctgccgcaggagccgctgctggcgcatcgccctgcaggctgttcatgcggctcaatacgtcccggaccatcgattcaattgcgtcggtattcatggagttatcctttatcaaagcgtcacgcgcagttcctgcgggtttttgcccgtcacgacgtacttggtctctttaatgtgcaaaatggccgactttgcctggtacttcgggcgtgccatctggtcatttagcgtagggaccggctgcggtgattcgcgtttcgcatagcgggcggcgtttttaccaatctgacggtaggtttccagcgtcagcagcggcgcctgcgggaacagctccaggttggagagcggcggtagcccctgctggtggataaccgtagtatctttcgactggatgccgatggagatgccggagccgctcaggcggttaccttcaacggcgacgaacgccacgtcggaagatttaaagcagcgaatcacgcgcgccctgataccttcttcttcaataccggcaatgacttcgcgcaggatgctcttatgcggtaagccgacgatattaacagtctgtgccaggccaaatgccgggccgacggcgataatgacttcgtcctgctgagtgccctggcgtgcttcgcccacttcggtcagaaagccgtcgcccgcaggcgcagcggtctgtggtgctgtggatgccgcaggcgtattaaacgagacgggtttatcgctgcccttcatatcgcggagcacgtcttcaattatctggcgcagcaatttttcattaatttccatttctcaccccttaatcaatctcgttgggatcaagagcgccagggatgtttttaatctcttcccagcgttctccctgcaggcgataacctgttgccggaccggcatagtcattgacgtcattaaccgcagagagcacttgtccgtcgccgacgataatggcggaggtgtgcaaatagtcgccggttagcttggctttctggatgttgagcatgtcctgggccacgtcggtaaacccgccctgcgccagcgctttaacgacttccagaccgttgcggtttttattgatgatttcctgggcgaacttgatgtcttcgacgatgttacgctccggcatatctttcgaaccgtgggcataggtcgcggcttcaacttcttcatcggtaatcggcggcagccccattccggcaaacacggcctgcagcgcgcgggcggctttgttacggatggcgataacgtcctcttcacgaaccgggcgcagaccgccgtccactttcaggtcgcgctggataacgttgtagtcgtcaaagtcttccgcatcttcgttggaaccggcgaacatgttgtcgtagttcggcaccgcggaataaccagaggagataaagtcggtacccggcaggaactgcatcagcaggcgcgcggtacgacgcatatcggagtgggtgaaggtctggtcgttactggaggagcattccagatccagcgaagagcagatcaggttttccgccagcacggcacgaatgcctgacggcacggcagacggtacgccgatacagcttacggagccattttgcagaccctgaacgccagccgctttggtgatatagatgcagcgcgcctccagatacagcatggatttgccttcggcgtagcccatctgcacttcggatccggagccggaggtgaagcgcattttcaggccgcgagaggcgtaggaagaggctaagaagcctttcgaccatggcgtatcgtcaccgtcggtgaagaccggctcggtgccgtaaacggaaatggtttcggcgtagcaggtgtggcccagcatgccgagcttcagctcggtggcttcttccagggagcactgagtcagtacgcccggacgaccaacctgagagccgaccaacagcgcgatggcgttgaacggcgcgtagcgtgctaccgcaaccgtggtttcttgttcgtcaaacccgcgccatgcgccttcggcggcatcggcggcaatttgcaccgggttatccttgacgttggtgacgtgcgcctgctgagacggcgtgcggcgtgcgcgcattttctgcatcgccatcatcatctcaaccacgttcatatgcgaaaccacttcaacaattttcgccggggtcatggcggtggtcagcggaacgatttcgctgcgcttgacgttcggatcgcagagcatgttagccagcttgaccgaatccatcgccatcacttcttcggcgcggttcaggttgatgccgtagcgggcgataaagtggtcgatcaggtcgaattcgctaaccggttttccgtccagctcggtcaccgcgccgttaacgattttaatcgacggttttggatcgttcgggctttccatcgcgataaagccttcttcgatccactccttaacgaagccgtcctgattcacagggcgtttcgccagtgcttcaaatcttttcgatctcatgaatcagcctcgtgggtatcagatgtaggacgggcgatcgtttttcggttcagaaccgagggtcgcaaggacggttttgccgatttcgcgggcggaggtcaccgcctgacggaccgcgccggagtcgccggaaatcaccagaatggcttcgttactaaagctggtgccgtgcgccggagagctgtacgccacgacttcaacgttggctgacttcagggcggtatcggccatcagtacgccaacggaagccggagcgccgacgatgacgccgcaggcacggccaatcggcgcgccgaacgttttttccagggcgtagctggcgcgagcggtgtactgcagctcgatatgcccggcttcgttgccgtaaacatcgccgaaggtgcggtccagctctttcagcgcgacttcgataccgcgcttgacgtcggaaacgtcgttaccgcctaaaataatcagcgaaccgtggcccgcgccgcctttggtatcgcgcggcagctcaatgctgaccacttcggtgttggtggctttcaccgcttcgtccgccgccataatgtgcgggcctgcgccggtgcgggcgccgagaatgccgatggaacgatagcgcttctcaagtttcatcgcgtccagcagggcggtatcgacgttggcgataaccaggccaagggtatcgccaatggcggtcccgacaaattccgttaaactgcagcttttttctgccatagccgtctctcgtataggttggggttgaccagggatggcctgttgttccggcgttgccacacgggcaatcacctgcgccatgatctgttccaccagctcattgctgctcattggctaattcccttcggtaagattttttctacatcggtgtgagggcgtgggatgacgtgtacggctttcacttcacccacgttgcgtgcggctgcggcacctgcatcggtggccgctttgaccgcgccaacatcgccgcgcacgatgacggttaccagcccggagccaatcttttcatagcccactaacatcacattggctgacttaaccattgcatcagcggcctctatgactgcggttaagcctttggtttctaccattcctagtgcttcttgttgcataaagacctcgcatggagtgttccgatagttgggactataagaagatgcgaggaaaaagaatggctgacttgctgttgagcatcagaaaataatgggaaagcaatatgactaaattgtcttttgcttttataacttattgataaattacatttaatttattattgtctatatgattattttgtttttattatttcatttttacatttttgttagtgacgagagtatttttatttgatatggcgaaagacgcaaaatgtgatgcttattcgaaattgataagttggcttgtgcaatattttattattttcacaggcgtattttatagctcgaatctcccgtatgataggctgctaaaaatatcggaaaagcaaaattttgctatcgcaacacgatttttccgggagacaggttcgcaggttgccaacaatttacaggcggcactttttatagtgaggttagctgtactctaccgccagccgaaacttgcgctggccaggacacgaactttgctcagaaggtgtcacatgaatgattctctaaaggcgcaatgtggtgcggaatttttaggcaccggactctttttgttttttggtatcggttgtttgagcgcgctcaaagtcgcaggcgccagcctcggattatgggagatttgcattatttgggggcttggaatttcactggccgtttaccttactgccggaatctccggcggacatcttaaccctgcggtgacgattgcgctgtggctgtttgcctgcttccccaaacagaaagtattgccttatattattgcccagtttgccggcgcttttggcggcgatctgctggcgtatgtgctttatagtagcctttttactgaatttgagactgcgcatcatatggtgcgcggtagcgtcgaaagtttgcaattagccagcattttcagtacctatccggccgcagcgctaaatgtatggcaggctgcgttggtggaagtggtcattacgtcgatcctgatgggcatgatcatggcattgacggatgatggcaatggtattcctaaagggccgcttgcgcctttgcttattgggatactggttgccgttatcggcgcgtctactggaccccttaccggttttgcaatgaacccggcgcgtgattttggtcccaaactgttcacatggttagcggggtgggggaacatggcgatgagcggtgggcgagagatcccttattttatcgtgccgattgtcgcgcctgttatcggcgcctgtgctggagcagccatatatcgctattttattggtaagaatttaccttgtaaccgctgtaaactgtaagaaaatgcgaaccagattcacagcaatgatgtatcgtaaaaacaggtgagataatttcgtgatctgctttcacgaactgatcaaaacgtctcccagcaatgggagacttttgatattgtcattgtactttttatcagggccaggataatgctaataaaaagtgaatgtaaataatgtgttttgtttataacaataaattaactgaggggttttatcatgatttctgcgagcgctctgaactcagaactcattaataaaatcgcacaggattttgcacaagccaccaccggtctggcggttgtggttgtcaatattcatggtgatgaaatatctgagctattcaatttcacgccgttttgtcagttgatgcggcagcatccccagcatagtacacgttgtcgtatgagcgatcgctgcgggggactggaggcatcgaagtccgatcaaccctgtatttatcgttgtcatgccggtctaacggatttttctattccgctggtaatcgcagggcatttagttggctttgttttatgcgggcaggttcgtttaagtaatgacgtggagctggtaaacattcttaatgtcgacgatcgctggcaggctgaccctgagctcttgaatgaatttcggaatgtgccagagatggactattcacgcgttatcgcttccgccgatcttcttaaactgatagttgagaattgcctgaaaaaacagctcaatttcgtggttatcaaagacaatccgcagcaatcggaggcaaataaaaccactcgtggccccactccgcatgacagtaaaatgaaaaaagcgcttcgctatattgatgcgcatttgtccgacgatcttcgtcttgaggatgtcgcctcacatgtctatctcagcccctattacttcagtaagctattcaagaaatatcagggaatcggatttaatgcgtgggtgaaccgccagagaatggttagcgccagagaattgctttgccatagtgactggagtattgccagtattgcgcgtaatttaggcttttcgcaaaccagttatttttgcaaagtcttccgccagacctatcaggttacgccgcaggcttatcgtcagcagataaatgagaattctcatcctccatcgatataaatagcaatattttgctattgccgatttttgatagtgttttgtatcttaatcatttcagaaagaaaatttatctggtgtaacaataaattgtcatagcgcaacaaaataataaaatttagggcataaactgcaccagtttttatttttgtgatgaagtacagtgtcaggaaagataagttttattacgctttgtcgatacgttttatcgtcaatataccggtaaggatgagtagattaacgtcagatgagcaaccgctcaggctattgctcacagaaatgtaaaacgtagcacattattaattgccgttatgggtgtgccgtacagccataacgtaaaccaacaggtttgccacatttgtggtagggaagggggtgaaaatcccccgcagcccccgctgctgtgatgctgacgaccccgtaaagaccactgatcgcaagattgggaaggacgggcgaggaggacgctaagccagaagacctgcctgtcggtgataaccaacaacttcggtgggaagtgggttgcgaagacgcgtacagtcgaaagactgaacatgcgcgtacctgtatacccctaccaccctgaacaggatcagggtaatggcggcaaggcatcacgctttattcttgcaggcacaggaagcggttgcggcaaaaccacggtgacgcttggtttgttgaggctgctgcaaaaacgcgcgctgcgcgtacagccgtttaaagttgggccagattaccttgataccggctggcataccgctatctgtggcgtggcgtcccgtaatcttgacagtttcatgcttcctcctcctgttctcaacgccttattttgcgaacaaatgcggcaggcggatatcgctgtcattgaaggcgtcatggggctgtatgacggctatggcgtcgaccccaattactgcagcacagccgcgatggccaaacagcttggttgcccggtcatcctactggtggacggcaaggctgtttcaacgtcgcttgcggctatcgttatgggatttcagcacttcgacccgaccctcaacctcgcgggcgtgattgtgaatcgcgtcactagcgacgcccactatcagctcctcaaaaatgccattgaacattattgctcactgccggtactggggtatgtccctccttgcgacggcgtcgcattacctgaacgccacctggggttgattaccgccagagaatccctcgtcaatcagcaatcatggcatgattttgccgccacgctggaacaaacagtggatgtggatgcgctactctcgctgagcctgttatcagcgcttccggcgggaatgtggcctgaacgccccgataacacagcgggggcagggctgacgcttgctctggcggatgatgaggcctttaacttttattaccccgataacatcgatttgctggagcgtgccggcgttaacattgtgcgttttagcccactgcatgaccgcgcattgcctgattgtcagatgatctggctgggcggtggatatcctgaattatacgccgcggatctggcggcaaatacggcgatgttaaaacatttgcgggcggcgcatcagcgcggcgtggcgatttacgcggagtgtggcggtctgatgtatctggggagcactctggaggatagcggcggggaaattcatcagatggcgaatattatccccggtcacagcaaaatgggtaagcgacttacccgctttggttactgtgaggcgcaggctatgcagccaacgctattggcggtgcctggcgagatagtgcgcggccatgaatttcactactcagattttatccccgaaacacccgccgttatggcctgtcgtaaggttcgcgatggccgcgtgttacaagaatggactggcggctggcagacaggcaacacgtttgccagctatctgcacgtccatttcgcccagcgtccggaaatgttgcagcactggctggcggcggcgaggcgagtattatgacgatccttgcctggtgtatcgcctgggtgctggattttatcatcggcgaccctcaacactggccccatccggtacgctggataggccgattaattacgtttgtgcagcgtattgtgcgtcgctattgtcccggcgataaagcgctgcggattggcggcggcgtaatgtgggttgtggttgtcggggtgacctggggcgtggcatggggcgtactggcgctggcgcagcggattcacccctggtttggctggagcgtcgaagtctggatgatctttaccacgctggccggacgctctctggcccgcgccgcgcaggaggttgaacgaccgttgcgggagaacgaccttgcggaaagccgaataaaactctcctggatcgtcgggcgcgatacgtcgcaacttcagccagcgcagatctatcgcgccgtggtggaaacggttgcagaaaacaccgttgacggcattatcgcgccgctctttttcctctttctcggcggcgcgccgctggcgatggcctacaaagccgtcaataccctggattcaatggtgggctacaaacatgaaaaataccgggcgattggtatggtcagcgcccgtatggacgacgtagcgaactatttgcccgcccgactgagctggctgttgctgggcattgcggcaggactgtgtcgcctgagtggttggcgggcgctgcgtattggctggcgtgaccgttataaccacagtagcccaaattgcgcctggtcggaagcgtgtgtggctggcgccttaggaatccagctcggtggcccaaataactactttggcgagcgtgtggacaagccctggatcggcgacgcgcagcgcggtatttccgtggacgatatttcccgaacgattcgattgatgtgggtcgcttcaaccctggcgctggcgctgtttattgcggcgcggtgcgggttatctggcgtggcctgaggacgacagtatgcattatatccagcagccccaaaccattgaggccaacagtttcaccattattagcgacattattcgcgaaacgcgtcctgattaccgtttcgccagtccgctccatgaggccattatcaagcgggttattcataccaccgccgatttcgactggctggacattttgtggttctctgccgatgcgctggagcagctttgtgatgcgctacgccaaccgtgcattatttataccgataccacgatggcgctgtccggcattaataaaagattactggcgacgtttggcggcgagtgtcgctgttatatcagcgatccgcgcgtggtgggcgtaccggtaggctttgtcggcgcggcggagtccaaagaggcgctcacccatagccattttcccgcggttgccgcgttagggcgtaaaggcggcagtaacgtggctgccgctatcgtcaatgcgctgctctatcacctccgggaggcctgatgagcgagctttcttttgacgcgccggtctggcgccacggtaaagcgttacgtaaaggatataccaccggttcctgcgcgacggcggcggcaaaagtcgccgagctgatggtattacgtcaacatctgattcatcaggtctccatcgtcacgccgtcgggcgtcacgctatgcctgaacgtggagtcgccgcacattgaaggccagcaggcgatagccgcaattcgtaaagatggcggcgatgacgtggatgccacgcacgggatgctgatttttgcccgcgttacgctcaacgacagcggtgagattacgctcactggcggcgaaggtattggtacggtaacgcgtaaaggggttggactgccgctcgggagcgctgccatcaatcgtacgccgcgccataccattgaatctgcggtgcgcgaagcgataggcccggcgcgtggggctgatgtggagatttttgccccggaaggcgaagtgcgggcgcagaaaacctataactcgcggcttggcattcttggcggcatttccattattggcactaccggtattgtgacgccgatgtcggaagaaagctggaaacgctcgctatcgctggaactggagatcaaacgggcgtcaggattaacgcgggtgatactcgtgccgggcaaccacggcgaacggtttgttcgcgaacaaatgggcgtcgacacacaggcggtcgtcaccatgagcaattttgtcggctacatgattgaagaggcggtacggctgggattttgccagatagtgctggtgggtcatcctggaaaattgatcaaaatcgccgccgggatctttcatacccatagccatatcgccgatgcgcgcatggaaacgctggtcgcgcatttagctttactgggcgcgccgctggagttactcaccctggtcggcgattgcgataccactgaagcggcaatggagcacattgaagcatatggcttcgggcatatctataaccatcttgccaggcgtatttgtttgcgagtcatgcagatgctgcgttttaccaaaacgccgcctgtctgcgacgccatcctgttttcttttgataaccatattctcggcagtaatcgtcccgtcgacgagattgctaaggagctgcaatgctaacggtcgtgggaatggggcccgctggacggcatttgatgacgcctgcggcgctggaagcgatagaccacgccgatgcgctggcaggcggtaaacggcatttggcgcagtttccggcgtttggcggcgaacgatttacgctgggcgcggatattggcgcgttgttgtcatggattgccgcccgtcgggataaagggatcgtggtgctggcctccggcgatccgctgttttatggcatcggtacacgcctggtggcgcattttggtatcgaacaggttcgcattatccctggcatcagcgccgtacagtatctgtgcgcacaggctggaattgatatgaatgacatgtggttgaccagtagccacggtcgttgcgtcagcttcgagcagttggcgaaccatcgcaaagtggcgatggtcacggatgcccgctgcgggccgcgggaaatcgcgcgggaactggtcgcgcgtggtaaagggcatcgcttgatggtgattggtgaaaatctggcgatggaaaatgagcggatccactggctacccgtcagtgcggtcaacgccgactatgaaatgaatgcagtggtgatcctggatgaaagatgagctttttctgcgcggcgagaacgtgccaatgaccaaagaggcggtacgggcgctggcactgtcgaaacttgagctccaccgcgccagtcacctgattgacgtcggggcgggaacgggaagcgtctcaattgaagcggcgctgcaatttccttcgttgcaggtgacggctattgagcgtaatcctgccgcgctacggctgcttgatgagaatcgtcagcgctttgcctgcggcaatatcgatattctccccggcgaagcgccaatgaccataaccgggaaagccgatgcggtgtttatgggcggcagcggcgggcatctgacggcgctgattgactgggcgatgggccatctgcatcccggtggccgtctggtgatgacctttatcttgcaggaaaacctccatagcgcgctggcgcatcttgtgcacatcggcgcatgccgaatggactgtgtacagcttcagctttcatcgttaacgccgctgggggcgggacactatttcaaaccgaacaaccctgtttttgttatagcctgtcagaaggaagaaaaccatgtcagagacatttgatccacgctgtgtatggttcgtcggcgccgggccgggcgatcgcgagctgatcacgcttaaaggctaccgcctgctgcaacaggcgcaggtagttatctatgccggttcgctgatcaataccgaactgctggattactgccccgcgcaggcagaacgctacgacagcgccgaactgcatcttgagcagattatcgagctgatggccgcgggcgtgaaagcgggaaaaacggtggtgcggttgcaaacgggcgatgtctcgctgtacggctccgtgcgtgagcaaggcgaagagttaacccgccgtggtatcgactggcaggtagtgcctggcgtcagcgcgtttctcggcgctgcggcggagctgggtgtggaatataccgtaccggaggtatcgcagagtctcattattacccgtctggaagggcgtacgccagtaccggcgcgcgaacaactggaggcgttcgccagtcaccagacgtcgatggcgatttatctctccgttcagcgtattcatcgggtggcggaacgtctcattgccggcggttatccggcaactacgcctgtcgcagtcatctataaggctacctggccggaaagccagaccgttcgcggcacgttagcggatattagcgacaaagtacgtgatgctggcatccgtaagacggcgctaatcctggtcgggaattttctgggtaaggagtatcactactcaagactttatgcagcggactttagccatgaataccgtaaagcctgaatccattgcgttgttttgcctgacgcccggcggcgtggcgctggcaaagagactcgccgcgatgctgccgttaacctgctttaccagtgaaaaactgcgggaagagggatttattcccttcgatggcggattcgctaataccgcccggcaggcttttaccacttataccgcgcttatttttatcggcgcgaccggcattgccgttcgtgtcctggcgccgttagtgaacgacaagttcagcgatccggcggtggtcgtcattgatgaacgtggtcagcatgtcattagcctgctttccggtcatgcgggcggggccaatgccttgacgcgctacctggcaggaatgttaggcgccgatccggtgattaccacggcaacggatgtcaatgagatgtccgcgttggacaccttagctttccagcttaacgcccgcatgtccgatcttcgaacggcggtaaaaaccgttaaccagatgttggtcagtcatcaacgtgtggggttatggtgggatgccgaactaacggaagagatcggccagtgtgatattcgcggttttatccctgttgatgatttgcagcggttgcctgaactggatgcgcttatctgcgtctctttgcgtaatgacctccctgagcttcccgtactgcactggaaactggtgccccagcgcgtggtggcgggaattggctgtcgccgcgatacgccatttcccctgttagcgacattactggcgcgtcagcttgaagcgcagaaactcgatccgctggcgttaaaagcgattggcagcgtcacgctcaaaaaaggggagccggggcttattcagctcgcctcctgctgccgcgtgccttttaaaacctttaccgccgaagcgttgcgcgaattcgaacaccattttcccggttctggcttcgtcagaaaaacggtgggcgttggcagcgtatccggcccggctgcgtggttattaagccagggtcaattgttaggcgaaaccctgcgcgaacagggcgtcactattactttgggagtttcacactgatgttaagcgtaatcggaattggccctggctcacaggcaatgatgacgatggaggcgattgaggcgcttcaggcggcggaaatcgtcgtgggctacaaaacctatacccatctggttaaagcattcaccggcgacaaacaggtgatcaagaccggcatgtgtaaggaaattgaacgctgccaggcggctattgaactggcgcaggccgggcataacgtagcgctgattagcagcggcgacgccggtatttacggcatggcgggactggtgctggagctggtgagcaagcagaaactggacgtcgaggtgcggctcattcctggcatgaccgccagcatcgccgccgcctctttactgggcgcgccgctaatgcatgacttctgccatatcagcctcagcgacctgctgaccccgtggccggttattgaaaaacgcatcgttgccgccggagaggcagactttgttatctgtttttacaacccgcgcagccgcgggcgcgaagggcatctggcgcgcgcgtttgacctgcttgccgccagtaaaagcgcgcaaacgccggttggcgtggtgaaatccgccggacgtaagaaagaggaaaaatggctgaccacgctcggcgatatggattttgaaccggtagatatgaccagtctggtcatcgttggtaataaaacgacctatgttcaggatgggctgatgataacgccgcgaggttacacgctgtgaatgagggggaggtgctggtggtgggcggcaccagcgatgcgcgcgcgttatgccgacaactgggtgcggcgaacgtcgcgtacaccttatctgtggcgacgccagccggaaaagcgctggctggcgacattaaaggacaggtgcgctgtggtcgtctggagtacgggcagatggtcgcatggctaaaagaaaaccgtactcgctgggtaatagatgcgtcgcatccttatgcagaaatggtcagccataacctccttcgcgcctgtgaaacggcggacgtgttgttaagtcgttatcagcgtccggagcagcttagcaatctgacgcatccgcttctctatacggcgcgcagtattgccgatgcctgcgagatagcgaggcgttttggtccgcgcgtgttactgacgaccggcagtaaagatctggccgtctggcgtgccgggctggcggaaaaaacgttgctggcgcgcgtactgcccgtggcggaggtgattcaacgctgcagcgaactggggttcggcgttggagaaattttcgcactgtgtgggccgttcagcgctgattttaacgccgcgttttaccgccagtgccgggctgacgtggtcattaccaaagcgtccggcgcggagggggatatcaggaaaaagttcagccctgtctggatgcgggcattccctgcatcgttattgcgcgcccgacgccgctcgtgacgggtgatgagttactggaaagctaggccgcctttgcgcagcgtttatcgcgctggctggccgcagctaaggagtaaaaatgaaaaaagcgcttctggtggtcagttttggcaccagctatcacgacacctgtgaaaaaacattgtggcgtgcgaacgtgatctggcggagtcctgtcccgatcgcgacctgtttcgcgccttcacttccggaatgatcattcgcaagcttcgccagcgtgacggtatcgacatcgatacgccattacaggctttgcaaaagcttgcagcacagggatatcaggacgtggcgattcagtcgttgcacattattaacggcgacgaatatgaaaaaattgtccgtgaagtacaaatcttgcgtccgttatttactcgcctgacgctgggcgtgccgctgctgagcagccataacgattatgtgcagctaatgcaggcgttgcgacaacagatgccatcgctcagacaaacggagaaagtcgtttttatgggccacggcgccagccatcatgcattcgcagcttatgcctgcctcgatcatatgatgaccgcgcagcgcttcccggcgcgcgtcggcgctgtagaaagctacccggaggtcgacatcctgatcgacagcctgcgtgacgaaggcgtcaccggcatacatttgatgccattaatgctggtggcgggcgatcacgccataaatgatatggcttcagacgacggcgactcatggaaaatgcgctttaacgcggcgggcattccggcgacgccgtggctgagcgggctgggagaaaacccggctatccgggcgatgtttgtcgcgcatttgcaccaggcgctgaacatggcggtagaggaggcggcatgaacggtaaattatacgcattaagtaccgggccaggcgcgcccgacctgataaccgtccgcgcagcgcggattcttggctcgctggacattctgtatgcgcccgccggtcgtaaggggggcgatagtctggcgttgtcgattgtgcgcgactatctcggcgagcagacggaagtacgttgttgccatttccctatgagcgctgacggcgccgagaaagaagcggtctggaacgaggttgccgccgcgcttaccgcagaggtggaagcgggtaaacaggtcggttttattaccctgggcgatgcgatgctattcagtacctggatttttttactccagagaatcggctgcccggagtggctggagattgtccccggcgtcacgtccttcgccgcgatagccgcccgcgcgaaaatgccgctcgccatagaacggcaatcgctggcggttatttcttgtaccgcgccggaagcggaaatagcccaggcgctacaacagcatgatagcctggtgttgatgaaagtgtatggccgattcgcccgtattaaagcgttgctggcgcaggctggcctgctggaatgcgccttaatgatgtccgaggccacgctgcccggcgagcagtgctggcgccacctccacgaggtcaacgatgatcgagcgttgccctatttttcgaccattctggtcaataaacagtgggagtatgcagaatgaaacttgaacagcagcttagacagttgtctttcagtggactggctgcagcgctattgctgatggttgtcccgcaacaggcgtttgcgatgcatatcatggagggctttttaccgccagtgtgggcgctggcctggtggttactgtttttaccctgcttgtggtatgggctggtacgcttacggcgtattgtgcaggaggataatcatcagaaggtactgctggcgctgtgcggcgcgtttatttttgtcctgtcccgctcaaaattccgtcggtaacggggagttgttcacatccgaccggcgttggtctggcggttatcttgttcgggcctggggtggtggcgattctcggcgcggttgtgctgttgtttcaggcgctattgctggcgcacggcggcctgacgacgcttggcgcaaacggaatgtcgatggcggtgattggcccggttgtcggttatctggtgtggaaaatggcctgccgtgccggactgcgccgcgatgtcgccgtttttctgtgcgcgatgctggcggatttggcaacctattttgtgacttcagtccagcttggcgttgcgtttcccgatccccatgccggagcgacagggtctgttgtgaagtttatggggattttctgcctcacacagattcctgtcgctattgctgaaggtttattaaccgtcatgatttatgaccagttaaccaaacggcaagtgattaccgtacaaggacattaaaatgaaaaaaacgttgatgttgttagcgatggtggtggcgctggtgattctgccgttttttattaaccatggcggtgaatatggcggttcagacggcgaagcggaaagccagattcaggctcttgcgccgcagtataaaccttggtttcagccgttatatgaacccgccagcggtgaaattgaaagcctgctgtttacccttcagggctctcttggcgcggcggtgattttttatatcctggggtattgcaaaggtaaacaacgccgtgatgaccgggcttgatcgactcagctatcaaagccgctgggcacacgttgcgccgcagcgcaagtttttgctgtggctggcgatgatgatactggcgtttgttctgccgcctgtagggcagggcattgagctgctgatcattgccggattgagctgttggctattgcgcatatccctctggcgttggtgtcgatggatggcgataccttttggatttttgttggtcggcgtgataacgattatcttcagcatcagccgcgagccgcaaatgctgctggctggcatatctgttgggccgtactggatcgggattacccgtgcgggcgtggttacggcgaatgaaacgttctggcgtagcctgacggcgctgtccgcgacgttgtggctggtgatgaacctaccgtttccgcagttaattagcttgcttaagcgcgcgcatattccacgcctgcttaccgagcaaatcctgttaacgtggcgctttctctttattcttctggatgaggcggtggcaatccgtcgtgcgcaaacgctgcgttttggttattgcagcctgccgaacggctatcgatctctggcaatgctgactggactcctgtttacgcgggtgttaatgcgttatcagcaaatgaccaccacgctggatatcaaactgtatcagggtgattttcacctgtaaggactattatgcttgccacttcagacctgtggtttcgttatcaggatgagccggtacttaaagggttaaatctggatttttcgctctcgcctgttaccggtttggtgggcgcgaacggttgtgggaagtctacgctttttatgaacctgagcggcctgttgcgtccgcaaaaaggggccgtattgtggcagggaaaaccgttggattacagcaagcgcggactactggcgctgcgccagcaagttgcgacggtttttcaggaccctgaacagcagattttttatactgatatcgatagcgacattgcgtttagtttacgtaatttgggtgtgccggaggcggaaatcacgcgccgcgtcgacgaggcgctaacgctggttgacgcccaacattttcgccatcagcccattcagtgtttgagtcatggacaaaaaaaacgtgtggctatcgccggagcgctggtgctacaggcgcgctatctattgctggatgaacccactgctggtcttgatcccgcagggcgcactcagatgattgctatcatcaggcggattgtggcgcagggaaatcatgtcattatctccagccatgatatcgatcttatttatgaaattagcgatgccgtatacgtgttacgccagggccagatcctgatgcatggcgcgcctggcgaggttttcgcgtgtacggaagcgatggaacacgcggggctaacccagccctggctggtcaaacttcatactcaactgggactgccgctgtgtaaaacagaaacggagttttttcatcgaatgcaaaagtgcgcattcagggaggcgtcatgacgcaggcagttatgttgcaggggacggcatccgacgtcggcaaaagtgtgctggtggccggtttatgccgcattttttatcaggatggtctgcgtaccgcgccgtttaaatcgcaaaatatggcgcttaattctggtattacgccggatggtaaagagatggggcgggcgcagatttttcaggcggaagccgcggggatcacgccagatgtgcgtatgaatccggtgctgctcaaaccgaccagcgatcgccaggcgcaggtcgtgctgatggggaaagtggcgaccaatatggatgcggtgagttaccatgactataaaccgcgtttgcgtgagcaaatccttgcggtctataacagcctggcgcaggaatatgacgttattgtgctggaaggcgccggaagcccggcggaaatcaatctgcgcgatcgcgatatcgtcaatatgggaatggcggaaatggcccagtgtccggttattctggtggcggatatcgaccggggcggcgtattcgccgctatttatggcacgctggcgctactgcacaaacaggagcgtgacagagtaaagggcgtcattatcaacaaattccgcggcgacgtggcgctactctattccggtatcgaacaaatcgaatcgcttaccggcgtcccggttctgggagtgatgccatggctggatgtggatctggaagatgaagatggcgtcgcgctgcaaaacgataaatatcgcggtaacgccccccgtgatatcactattgccattgtgcaactgccacatatttctaactttacggattttaacgctctggcggcgcagccggatgtgcgcatacgctatattcgccgcccggaagcgttgactgacgctgatctggtgatcctgccgggcagtaagaatacgctgagcgacctcgcctggctgcgcgaaagcgggatggcggatgcggtattgcagacacatcggcagggcgtgccggtgatgggaatttgcggtggctaccagatgctgggcgacactattgtggatgaggtggagtcggggctgggtacgcagccgggcctgggactgcttaatacgatcactcgctttgcacaggataaaaccacgacgcaggttaacgcgacaatgtcaggcgagctgcccggctggctggctgccgcggcggggctaccggtacgcggttatgaaatccacatgggggaaacggtgctgcaggaaggatgctgtacggccatgacgttacagaaaaatggatgctctgtggcggatggcgcggtcaccgccgacggactggcgtttggcacttaccttcacggtctgtttgacagcgatgcctttacccgtgcggtggtcaatgggttacgggcgcgaaaagggcttgcgccgtgggaaacgactttttgttatgcggagcataaagcgcggcaatttgatctgctggcggaagcgatgcggcaacatattgatattgataaaatttacaccatcatgcaacagcatcaggagccggtatgatgattctggtgacgggcggggcgcgtagtggtaaaagccgtcatgctgaagccttaattagcgatgcgccgcaggtactgtatatcgccacctcgcagattcttgatgacgagatggcggcgagaattcagcatcataaagatggcaggccggcacactggcggaccgcagaatgctggcggcatcttgatacgttgattaccgcggatcttgcccctgacgacgcgattttgctggaatgtattaccaccatggtgacgaatctgctgtttgcgctgggaggcgaaaacgatcccgaacagtgggattacgcggcgatggagcgcgccattgacgatgaaattcagattttaattgcagcctgccagcgctgcccggcgaaagtggtactggtgacaaatgaagtgggaatggggatcgtcccggaaaaccgcctggcgcgccattttcgtgatattgccggtcgggtcaaccaacgactggcggcagcggcggatgaggtctggctggtggtctcaggtattggagtcaaaattaaatgagtaagctgttttgggccatgctcgcttttattagccgcttgcccgtgccgtcacgctggtcgcagggactggatttcgagcagtattcgcgtgggatcgtgatgtttccctttatcgggttgattctgggggggattagcggcctgattttcatcctcctgcaaccctggtgcggtattccgctcgcggcgttgttctgtattttggcgctggcgctgctgaccggtggttttcacctggatgggctggccgatacctgcgatggcattttttccgcgcgccgccgcgagcgaatgctggagattatgcgcgatagtcgtctgggaacccatggcgggctggcgcttatttttgtgctactggcaaaaattctggtggtcagcgaactggcgttacgtggaacgccaatgttggcggcgctggcggcggcctgtgcggccggacgcggcagcgctgttttattgatgtaccgtcatcgctacgcccgtgaagaggggcttggcaatgtatttatcggtaaagtcagcggacggcaaacctgcattactctgggattggcggtaatcgtcgccacggtattactgcttggtatgcaaggcctggccacaatggtggtcacactcgcggcgattttcatccttggccagttgcttaaacgtacgcttggcggtcaaaccggcgatacgctgggcgcggcgatcgaacttggcgaactgatctttctgctggctctgttatgagccgattattacggacgagacatcttatgcagacactacacgctttattccgtgacattcctgcgccggacgccgaggcgatggcgcgtgcgcagcaacatattgacggcctgctcaaaccgccgggtagcttgggcagactggaaaccttagccgttcagctcgcgggaatgccgggtcttaacggtacgccgcaggtaggtgaaaaggcggtgctggtgatgtgcgccgaccatggcgtctgggatgaaggcgtagcggtttcgcccaaaatcgtgacggcgattcaggcggcgaatatgacgcagggaacaaccggcgtatgtgtgcttgccgctcaggctggtgcaaaggtgcatgtcattgatgtcggtattgatgccgaacctattccgggcgtagttgatatgcgcgtcgcgcgcggctgcggaaatattgccgttggcccggcgatgagtcgctctcaggctgaggcgcttttgctggaggtttcccgctatacctgcgacctggcgaaacgcggcgtgaccttatttggcgttggggagctgggaatggcgaacactacgccagccgccgcgatggtcagcgtttttacaggaagtgatgcaaaagaggtggtggggattggcgcgaatcttccgccttcccgcatcgataataaagtagacgtcgtgcggcgggcgattgcgattaatcagcccaatccgcgcgacggcattgatgtgttgtcgaaggtgggggggtttgatctggtcgggatgaccggcgtgatgcttggcgcggcaaggtgtggcttacccgtattgctggatggctttctttcctactcggcagcgctggcggcctgtcagattgcgcctgcggtgagaccttatctgatcccgtcgcacttttcggcggaaaagggcgcccgcatcgcgctcgcgcatttgtctatggaaccctatttgcatatggcgatgcggttaggtgaaggaagcggcgcggcgctggcgatgccgatcgtggaagccgcgtgcgccatgttccacaatatgggggaattggcggccagtaatattgtcctgccggaggggaacgcaaacgcaacataacccgggcgcacaacaccagccatgtgagaaaaaagctatacttaacgcacacctgccgcgacaaaggaagggatataatgcgtcgtatcacacctttttttccgtttttcgtcttgttggtaagccatttctcgctggctataagctatccgttgccgcccgaaggcagtcgtctggtaggacagcctgtcacaatcgccgtacctcagaacaatactcagcccttagagtcatttgccgcccgctatggtcaggggttgagtaatatgcttgaagcgaatcccggcgtggatgtgtttttacctcagtctggttccacactggtagtgccgcagcagttgattctgcctgacaccgttcgtgaaggtattgtggtaaacgtcgccgagatgcgcctttattattatcccgcaggcacgaatacggttgaggtactacccattggtattggtcaggctggccgtgaaacgccgcgcaactgggtaactgcggttgaacgcaaacaagatggcccggtttgggtgccaacggctaatacgcgtcgggaatatgctaaagagggaaaaacgctgcccgcgatggtgcctgcggggccggataaccctatggggctatacgcaatatatatcggcaggttatatgccacccatggcactaacgctaactttggcattggccttcgcgtcagtcagggctgtatccgtttacgcaatgacgatattaaatatttattcgaccatgttcctgtaggaacccgcgttcagattatcgacaggcccgttaaattttcggtagagccggatggcagtcgttggctggaggtacacgaaccgctttctcgcaaccgtgctgaatttgagtcagacaaaaaagttccattgcccgttacgccagtgctgcgcacgtttatcaaaggggatgacgttgatacttcgcgggttaatgaggtgctggagcgccgttccggaatgccggtcaacattagcgcaggcaggtctggcctttaaatatcctgccacattgctggttttcatgggctggaacatctgtattagtagtgagtgtcatggcaggggcttcattttctcaacgaaccgcgaggccgccgattaagcccccaaaaactatggatgccaaaaagcccggaaaaccttatcaggtcaaccgggtaaagataagttcttattttttaaacgtctccggactcgcagggatatcccgaaactaaaatctggctcctctgactggactcgaaccagtgacatacggattaacagtccgccgttctaccgactgaactacagaggaatcgtgtggggtcgtatattagcggcggaaaaatttttgtcaaaccccatttaaccccttacagattcgattgcgggttatctcatcactttgttgcatttgcagacattttttctgcaaaaagctttgcagccttacgatttctcgctcattattgaaatgtggtttcaactctcttctttaaggtccattttgaacgtctccactgccttacgccaggttgtcgtccgtacgccctggtatgccaaacgcaagagctacaaagtgttgttctggcgtgaaatcaccccacttgctatccccatttttctggaaaatacctgtgttttgctaatgggcgtgctcagtacttttctcgtcagttggttgggcaaggaagcaatggcgggcgtggggcttgccgacagttttaatatggtaattatggctttttttgcggctatcgatcttggtactacggtggtggtcgcctttagcctcggcaagcgcgataggcgacgggcaagggcggcggcgcgccagtcgctggtgattatgacgctatttgccgttgtgctggcagtggtcattcattatttcggcagtgaaattattaatattgtcgcaggcgaggcgacgccagaagtaaaggggctggcgttaacgtaccttgaactgacggtactgagttatccggctgcggcaattgcgctaatcggtagcggcgcgctgcgtggggcagggaatacgaaaatcccgttgatgattaacggcgggatgaacattctcaatattgtcatcagcagcatcctgatttacggggctttctcctggcaagggctgggttttgccggtgcggggctgggattaaccatttcgcgctacatcggcgcggtagcgattatttgggtgctgatgattggttttaatccggcgctgcgcattccgctgaaaagctatctgaagccgttgaatttcggcattatctgggaagtgatgggtatcggtattccggcgagcattgaatcagtgctgttcaacggtggcaagctactgacgcaaatgtttgtcgccggaatgggcactaacgttattgcgggtaactttattgccttttccgtggcggcgcttatcaatctgccgggtaacgcccttggttcggcgtcgactattatcaccggtaagcgtcttggtaccgggcaaattggtcaggcagagcgtcaattgcgccatgtattctggatgtcgactatcgtacttacggcaatcgcctggggaacagcgccgttcgcgggtctgtttgcctcattttatacccaggagcaggacgtaaaagaggtagtgaaagttctgctctggcttaatgctgcctttatgccaatttgggctgccgcgtgggtgctgccgtcgggttttaaaggcgcgcgcgatgtgcgatttgcgatgtgggtatcgatgctggggatgtggggctgtcgcgttgtggcagggtatacgcttggtattgtgctgggtatgggggttgtaggggtttggctggggatgtttcttgactgggccgtgcgtggcgcactgttttactggcgtctgataagcgggcgctggctgtggagatacccgcgcgtaaagagggagtaagagctttttgctgtgaaaatcatcaggaaacggtgaattttaaccgaagtgtggaataaagcagcaaacgaactttttttgtgaaaacaggctttgacaagccaggggcacctcgttaatattcgccccgttcacacgattcctctgtagttcagtcggtagaacggcggactgttaatccgtatgtcactggttcgagtccagtcagaggagccagattttagtttcgggacatcctggcgagtccggagacgtttaaaaaataagaacttatctttacccggttggcctgagaaggtctgccgggttttttgacatccatagtttttgggggcttaatcgggggcctcgcggttcgctgagaaaatggagcccccacctatggcattaaccgataccgctatccgcaagattaaacccgtatcagtatgctgacatatagaggtgttcgattcaaacggagcgatcacacaagcttgccaggtgatgcccctggtgggaatcgcgactgtctctttcatctgatttcagatatttcccgtgatcttgatccgttctttcccaaaagattgatttctttcattcgaaacaaggatgtacaataagtaaaccaaaatagtaactatagagtttctaatggatacagtagaagaactaaatggaacatacttctatgcaggaaaatccaatctgactgctgccgaacttctgttatgattttctgtgagaataccgcaagccagtttgggattggtgttgcagatttcggggctgttgttgctctggtatcaggtcgtaataatctttggacaagggcgaaacccgctggagcgactaaaggcacatcatacgcgtccaggactgcacgtgcagtgtttaaaaagtcaaaatttccctttggaatatcccttccgacatggttaggcggttacaccccgtggacagccagacgtgttatggttcgtaacattgcgccgtttgttggacgttccattcctttgatcggggaaattatccttgccgcagatgtgtcacaaatagcatatcgcactatacgcgactacaataccattgctcggggcaatgataagttatgctagacaatattgaacagcaagtttacgagcttgtacggccttatgctggcacatatctgttcaacattaagcaagtggaattaacaccagagattgaccttgatactgatctgagcattgatgaacttgaagccgaagatctcatgaataaattcttcgagaaactcaatgtcgagcgaggtaacttcagaatagaaacctattttcctaatcaccctttttcatggcatccgttcaagaaaacggagcctgtacccgtcccagatttcactatcagcatgctgatcgagtcagcaaaagccgggaaatggttatatgactaattgtaatgaacttaacaaatggctgtaccagtacccttctttttgagcgatgatggtggcgctaagatagttctcttttctttttaaagggttcatgtttactgccgccgcccttacgctaacccctttagtttcctcctttgctgtcatactatcgaatgacgtgcctcacctgtgaacgctaaggagaataatatggaaaataaaggcacaaacctgacacccgagcaggcgctggatcgcctggaggagctgtacgagcagtcggttaacgcgctccgtgaagccatcgctgactatgttgataacggcacgctgcccgatccccatgccaggcttaacggactgtttgtttatccttcgctgtctgtaagctgggatggcgcgacaccgaacccgcctaaaacacgcgcttttggacgctttactcatcccggctgttataccactaccgttacgcggcctgcgctatttcgcgcttatcttctggaacagcttaacctcgtttaccatgattatggcgcgcatattgcgatagaggcctcgcaccatgagatcccgtatccttatgtgatcgatggctcggctctgacgctggatcgttctatgagcgccgggctaacgcgccattttcctaccacagaactggcgcagattggcgatgagacggcagacggtctgttccaccccggcgaattctatccgttatcgcacttcgacgcgcgtcgtgttgacttctcgttggcccggttacggcactataccggtacgccggttgaacattttcagcccttcgttttgtttaccaactacacccgctatgtcgatgagtttgtgcgctggggatgcagccaaattcttgatcctgacagtccctatatcgcgctttcctgtgccggcggaatttggatcacggcagaaacggaagcgccggaagaggctatttccgatctggcctggaagaagcatcagatgcctgcctggcacctggtaacggcagatgggcaggggattacgctggtaaatatcggtgtcggcccttcaaatgctaaaacgatttgcgaccatttggccgtgctgcggcctgacgtctggcttatgattgggcactgtggagggttacgagaaagtcaggcgattggtgattatgtgctggcccatgcctacttacgcgatgatcatgtgctggatgctgttctgccgcctgatattccgattccaagcattgcggaagtacagcgtgcgctgtacgacgctaccaaagcggttagcggaatgcccggcgaagaggtgaaacagcgactgcgcacgggaacggtcgtcaccacggatgaccgtaactgggagcttcgttattccgcatctgcgctgcgattcaaccttagccgtgcggtcgcgattgatatggagagcgcgacgattgcagcccagggctatcgcttccgcgtgccttacggcacgctgctttgtgtttctgacaaacctttacacggtgaaattaaactgcccgggcaggcaaaccggttttatgagggggctatttcagaacatttgcaaattggtattcgtgctattgatttactacgcgcagaaggtgatcgtttgcactcacgtaaattacgcacgtttaatgagccgccgtttcgctaacgaaatgggctgtcgcctgctgttgggcaggagcggaagaggcatatttatgtgatatggaaagtggttgaatgaagccttagcgggaggtgattctgcatcccgctaaggccttattgtgccgcggcttcatcaccatcgccggagatctgtcgccgataatcgcgtctacgtcaggaaacgcgccggaaggcgaaaacattgcgccgcacttcacgctccttgagcgcctggacccacaagcccggattaacaagcagataccgaccgtgagaatcgatcagcttaaagggattatcagaaggcttgatactgaggattttcgcgttggacagggatatagggtggtcacgccattatcgaactgaaatggccccaaatcagaccaccaatttcaccggatgcgcaggtaaaaccagatacgcatcggtaaaggttttcacgctaacttattgaaacctaattaaatagggacttataagtacgcctgaaaacagaaatttggctcctctgactggactcgaacttcatctacatctcctgttattactgcttttgttaaacttagccatatttttaccaacatatttaccatcattattgttttcttgtggttaaaatgtcaattaaaaacaattggttgttgccataatcatctgactatacgtatctaaatttgctttcattatcaacatgatgttgtcgttattttttttaaaataaatgatgaaaaacaattggttattttttattaaataaatcatgtttagtcaaggtgaaagcactgacctccaaggtcacttactgtgctcacaccattttgaaaacccgctcctcttttccactttctctatcatgttgaatgggctaacgtttaggaaacacaaaagcaatcggtagaacaatgactacacaaaaggaaatggaagaaatcagggcagcgttatcttggtttgatgtacgccgatatgatggccttaaagacctcaccttagaacaaatctatgcagagcttgaaagacggatgttggcttacaaaacaagacaacaatgggaaacagcaggcaaagataatcaaatgcaagcgatataccatgatgccacaatccgatgtggtgatgtgatacttaaatcagactggatttcagacaatcacagactgtcgcatagctatgctgtaagaccaatgaccagagttcaattgttcaactatgggcgggctatgtatcggctggagacttcagagcaaacagaccctgttgcagtgagttccgactacatctctgagtatctgaaacaaggaggcatgaaccctgctaacaagatgctgattgaaattgacttggaagaagccagcagtgacgatctcgcagaacatctgaaagtactgattgctctatggcaaaagcacctgaaaacgcctaaacccccgaaacgaaaatttaggtttggtcataagacctttgaaagaatacttgattacaaagtcatccctttgatggatttgatctcatgggaacagctctacaacgaaggtaagaacatacctttcaccattttagctgacatcctgcatggtaataatggggtcagaagtagtgagaacatcaaagatactgattatgattacgcgaaaagttatcttgataacgatgagtacttcaaggttttaaatgatttctatattaaaaacaatatgttgaaggattggggtatcgttgatgtgataacacttaacgataaatcctcggataaaaacaaaaagtaaacacaagggatgttcacaacctgcgaacatccctaaaaagcgtatccctccaaaaatttccgcgaaactcacggttggtgaacatccctagtttagaaccagccaaaatcctagaattatctccatcgaacaacatactaaaaaacgaaatatccaagatattacgtaaaaaaaacaggagataatatggttcaaaacaaaacagataaacatccgaaactgattcgtttgccagaagtaaaaagaagaacagggtttggtaaaacgtggatatataccttaataagagcgggtaaatttcctaagcaagtaaaaaccggattgcgctctatagcatttattgaaagtgagattgatgaatggatttacaaaatcatttctgattctcgcaatcatatctaaaaaagtttattaaataatgagaggttaagatgaaaagtaaaaacgtactgccttgtgtggtgactgttacgaatgatgagacagaagtatttatggaaatggcaataaataactttagaaaacatcttcaggtcatgattgattgtatgggaaatgattacgagcgtcattttaaagaccggctttatattgaagaagtgattggaaaagtgatcgagcgaacaaaacgagagtttgctgaatcaatgaaagataataaagggaaagaatatcatctgttcttggatgaggtgagaaggaatctgagagttatttattctgcgtatcgtactaactattaatgagagaggtgaatatgaacgaaaaatgtttaggctggaatgaaatacccgttaaaatatccgcaagtaatgctgagacagcaaactttgctactgatgttgtaaatacctataacgagttaatacattacttatactttaatctaagtgatgatgaatttctgaaaaaaatgaaggatggattttacagggagatattcataatggatattattaatctcacgctacaggaatggtttgaaagtgctgaagagataaagattaaatacatatcagttccagaggttaaaaccatactaagtagttatcatgagtttttgattaaatgctttaatggtgatgattatcttctttattacaaaagaatagaaatcagcgcaaataaacagactgtaatataaaataagaggtaatgaaatgagtgaaaaactgataaaagaatctcaaaaagtatttatgcatatggcaggtttgttttatgaaatcaaaatgaatacgcttaaggaagtccgacccgatgaagcagagatgttaatggaggatgatgcattcatggatagtatttataaggattgtatcaaaaatgcaagcgcatcttttaaaaaggtagtcagatgggagtactttgaacaagggcattcagtaaaaatggttgataaggaggtggtgttgataacattacgtgttaatcacaaacgaagataaaaaggttatttaataaatcatttttagcctcattcatggggcgaaaaaaaagaaaacaaatatcatttaatagtgaggcgtaaccatgagtaaaatttttgaaattaaaagtgtatctacagaaacgttttataatattgcagagcgttcgtttgaggctagttggaaggttatgcaggatatggcctctgataatgtctcatacttggtatatgatgcggattttatgtgtgttttcatcggcaatgttattgagcatatcagtaaaaatttttacatcattatccaatgtgaatgtctggaaggaaagcttgaagaagtaaactttgaagaggtagcggaacgtctggtccggcattcatgggagttttgtaaataatatcaaaataaaaatagattaagaaatcatgggcagagttgttatctactcactgatttagattatgtggccccgtaatggggctgtacatcgattacaagaggaatatgatatgaatgatgtggtattatacgaaaaaaatgaatcaatgttttttgccatttgcacggtcttatcattatattgcgatttcatatacgaaatagcatatggatttcataatgaagcggtaatgatcattgaaaatgaaaagtgtgtgggacaggcacttaaaatacaaataaacaatctattcgatgatttcgattactacaaaaaagtgaatggaacagaaaaagtaaaacgggaagatatagatgaaaaagaactctttaacaaagtaatggcagcacataaccaaggagtaaaagcgctaatcatgaagaatcttgaggccaatcttcgagagaaagaggaaggttctgaatattggaagttaaaaatatttaataggtttaatgggatatagaagtcaatgtaggcttctatatattcagataaagaaagtagtcatgatctttatctcatcggagaaagtgtttttcatggctggatatttaaaaaattattttattttgtttttcattattttttcgacttcttttttttgtgatgtagataaattccttttaatctctttcattttgtttttaaaattaagattatctctttcatcatgcaaggacttcattttattatatgcttcgtcactgaaaggatgtaagttatcatctattttttcatctaagtaagaagaaaggaagcatctatcaaaataattttttctaagcgcatcgtaaattttagcactatcaataattgtttcatcttccggttctttttttatatggtctgtcatgttgactcctcttatttttagtggattgtgtatatattttattttaagggattggttcaaagtgtcaaatttaaatgttctttcaaaataacgttcaatggtattttgaagctttcaatgctggattatataagaatgatttacatgtttatttgaaaaatagctatcaacttaagtaccgggattcgggactttaactcccggaagtcggtacttgttttttagctataactggcctgagagcatttttttcttcattattcagttagtgaagatgagaacaactaatcatagatgctttaggaggcagttttactttttattgcattggtttcctctcttgaatttatatctcagcttagtgattgttaggaataatcactaagcgctgctgctgaaaatatagttttattatacgtttaagatcaaatatcataggttgtaaataacatgctacatttcaagatgtgatcattatcaattatcataaggaaataatctataacgaaactagaaaatttaaatttaccatataagttatacgctaaaacgaaataattgattcagtattagggcatagccgtgtgtaagtagtagatggaattttcaggaagaatgttttaaaaatacatgctcatattattttagcagtataaatgaatgtgattattgtaaccatgatgaaataaaaaataataaccctattataaaaagaggttgactgtctacaaatcgaataatatcataataactatttatgttattatgatattagttaaaaatggaaagaatatgaataaaagacttaatatgctatatgtcaacaacattaacgcattaaataattaccgtgaaaaacattcagataataacttacatggccccctccttttaaagctaaaaaattattttcatcagcataataaattgatggttataggacaggaaacctatggatggtgcaactctcccgatattaatgaacagcttgaaacatatgaggagttcgattttggcgtatcatattatagcagtccattctggaatatcataaggaaagtagagcgagcgcttggtattgaaccatatgcaattgcatggtcaaatctgaatcggtttgatgttgattgcggatcaccagattataccgagctagctagagatatatcatcgtttgattatatattaaaggaggaaattaatattcttactcctgatatatgtgttttcttcacaaatcataaatatgattatcgactaacgtctttatatgaagatttaatgtttgaaaacataaatggattgccagaaaaacatttcgtaagattataccatccagacctcccagaatatacgattagagcgcctcaccctaaaacaatcagaataaaaggatgggaaaatgatttcataaaatatatagaggctattaaatgattatgcagatgcgatcttattaatatgaataaacaaaattgtgttactaattgcataacagcaatataagttattctatagtttatctaggccacggcgtgtaggtggccttaaacgaggagtatgatttttatcatttattgttgaaacagtcggtataaaatccatgttattatctgcattgactcgttcgtgcttaggacggcttgggaaacgtcgaatctcatcaggtgttggtttgtaagtatcactgttaaacttagcttgtttctcatattcagcacgagaaacatgatgacctaatacttcatcaaagacatagttttcagcaatacgtttatcatgttctgtactgacaggatcatgcttaactctgcttgatctaggccatacaaatttttctttgaagaaatctatgacaagagttgtgaaacgtttgaaaatattatcctgacgtggagtagtcttatcctttctttcatggtcaggggcgcttctggatgccctgtttgggttttgagaggtggatgttttcagaatagtatttgtaccagaatcagaaatactgattgatggcggaatacaagcaacaaccttactgacttttgttttatcacggtaagatttgactccacgcaaacgagtatcaggagctggtgctaccagtaaaggtctttgttcttcatttgtagaagagctggatcgcgtttctggtaaaacaatttcttctggttcagcaagatgtgtaatcgtaaagcttctgacatcaacgacgatttcaagatcaagttcgctgaatgttttgtagacttcaacggcttcttgcttggcagcatcacgaacagcctgttctgcggctctttgctcttgagcagctttactgcgccatttggcactatggatacgtttcattgcagggcggtttgtttcagcggctttagcaagccatagcgcttgttcttcattgtccagagcagccgccgctttttctaatgcctcttcatgctgggcctgaagggaacgatggtcaatacgttctgatgaacctgcggcttcgagatagctgttagccatagatgcccatgactcacgccacaacacagacatttttctgtcgttccagcttctttcttttttaccaaaaccttccgggcctatggcttttaacgtcaacataacgtgagcatgtgggttgtcgctatcaagatcatgaaaagcgatgtcggcaatcatgcctttatcaacgaaatttttctgacaatactcaaggacaagttttttcttgtcgtcattgtttaactcggtgggaatagcaacatcgaaataacgggatgtttgaccattgttctggcgctcaactttttccacttcattccacaatgctgtagagtcttttacgatgtgttctggtgcgttagctggagctaatatgaaatgcccgtacaaatcagtacggcgactataatcataggtatcacctgttctttcatctgttatccttgtacgagcatgataggcagccttcgcaacggaagacctgccttctgaacgtttcacaattttaaaatcaagatgaaaaatagccatacaataaaaacaacctcaatataagtttaaatatcaaactaaaatataactctccaatgcgactatgctggttttagtttttcgcaagaaaaactctggtgttgacgttgaccttgtttccgaaggaaacggtgttagcctgcggcaggcaaccgtcggtagaccccacacactgcgtagcagtgtataggtgggcattgctttatttttatatctcctaaaggagctaaaaataacgacaatgtataaagcttttctatagttaaataataacgctagttttaatgtctgtgaaattaacggggctagattcggatgaacggctgaggtattacacgaatcttaatgattatggttttagagagcgcccgtaagggcaaaagagttaatttccctcccgccgtaaggcgggaaaagccaaatgcactaaaacagacttataacgacagtttttttaaaaaaatggatggtgtaggttcggacttaaaataagagtgaaaaagcaaagggtgaaaaataaaccataaggaaagagagtcaagtaacgtggggaatattagatgatttaggttaatgattttgattgtatatgttgcatgattacatatagagcttgttgcatttttgtgcagagtcttgtaaacaccatttttgttatcaccttttgtatcataaccattttagttattgctgattaaacagtaaaaataaaataaaaatccatgagatcatatgttaaatgtgttttttgacgaaatatatttaagtttgtctggtcttttttatttttaataaagttaggttgttttatttgacaagtaaaatgttgtgttgtaaataaaataaagatacaaaaaaagccaactttcaaagttgactttttaaggactaaaaaagttttgccgacttttgaagccttgtaatcagttagaggaataacgtgattacaaatataataaagtattaaataatcttttcatatttgtcaaatctaaatctcaactttttacaagcctttcaaataccatttccaaaaacattttagtcttcaaaagcaataacgttaaacctgtgtatcaggtctaagaatctttggacatcatgtgttaaaaactgttttgttcttaggttattgtaggtggcatataaacggggggaagtcggtagccaccaacttgaagcgttcatctaaaatctataaagcggtagtataattttctttagtaaaacgagaaaatgctttaaatgatcatgatgtatccgtaggagtccgatggggtgtcccagtaatggaaaccgtgctggaactcaatagctacggtgagaatcgccaaccctgcgaacctaaaaaaaatattacaatagtatttttttacggggggttaggggggtgaagcttgcagaaaaactaagttttcctgacggaaaactactacgactgaaagtcgctatctaaaaccccagaacctaatctaataaaattctagtactactagtacaaaaaaataattttaaaaatatcagtaggtaggtgccatttcatcaaggcactaacgaaagataagtaggcttataaattaaatatggtgcatggattaatttgagttttttgttttttaattgtattaattaaaaaatataaataaaaaggtaatgatatggaaagtaaaacaaaaaaactaagaatgggatggatacaaaatcttactgagaatgaaaaaaagataatagatgattttctggaagaagccgctaagttaaaaggtaaagcactaaataaaaaagaaaaacaaactgtcaaatttattgctcgtgatcaagtccgctcgattagaaaagagcaaaaatcaaaaaaacaaaagaagagtagagttgatatggaagaaaaagaagatgaaacaattaataccatttcaaataatgcggatgagcaaggaagattaaagatactatcagctaaagaaagagattttatcaataatgccatatatgaagaaatgaaaattaaaggtagaaagcttgtaaaatgtgaaatgaaagaagttttaaaaattgctcgaaaaaagatcctcaacaatcgtatatcttgtcagatcaaaaatgaaagaaataaagaaaggtttgaggcagagtttgaatggagaaaaccagtgccatttcgtcgttaaagcattcattaatgatgatattataattttttataagaggtaatacatgaaaaaattgaaaacaaaaaaattgaaagaaagtgagtttataagatatatagaaaacaatcctgttgtctcaaaggctttatgcgaggaatatggaatctgtactgaaacaattgcctatgcattatatgttcatagcaataacttctttcttaaaaacgactacgttcaggatgacattcactatgatatagttaaaaacaatttaataataatgaaacccacgcttagacaatattatagaagaacaaggcaagtagattataacggatatacttttttatcaggtattaaagaatatcaagactattgtattttgttgacgctttgctgctatcattggatagctgatgtatttactgtctataatcatagtgaaagaagtcaatttatcgttgatgttgccaatgatcttctgaaaaggagtatagatcatttttcagtagagcatgagaatgttatcaactgctttaatatgttaaaagaaaagctcccatcgtataaaaagaaataataatccaatttttcaaatatcctcattgactaacatatatataagaaatatatatgtatcatggaactataagaggatagaaaatgagtgatatttcagataaagagcaaaccagaaagaaaccacgaataaaaaagacactggagcagcaattagcatctgctcagatgcgtttaaatcgtttgcaatataagtctaagaaagaagctaaacagatagaaacacgtcagaaaataattttaggggctgaagttgccaaggctcttgattgtgatgtttttacggtggataaggatcttgttttaggtatgctactagagatacctcacctacatccagatgataaagaaagatttaaaagaagcggaatgttatttctggcgagcatgaaaggaaggaaaacttgataatgcatataaactatttgacaagtattttaggaaaagttccaacagataattatcgttaactttcattaaaagatttgacattctatttatgatgatatatctatttatttaaaatctcataatcttatataatcagattctttcatctataaaatcataaaaatataattttaggtttatatatttcacgtcctgacaaatctctagcttaattttaatatggctggggatttgtttttatctgtatcttgatttttgtttgttatttgataattaattaatacgtgaatataaaaatggcgatgaaaatgaaaaaacaaaataaaaaagggttctcattacttgaactcattttggtgctgggtgtcggtagtatgatggcttttatgcgttttcaggatatgaaaactgaacaagaaaatgttatggctaaggctgttggtcaacagatgaagcagataggtgaggcggtaaatggctatatcaatatcagatatgacaagctttctacgctgacgtcaagcagtagtcagtcaagcgatccgggtccccgtacttgtaatggttcaggttgtgaaataacgtatcaaacattaatcaatgaaggattattaccaacagcttacactggtataaacgttaaaaaatctccatataaaatactattaaaacgtgatggaactgctcctaactatgttattaatggtcttataacgacatcgacggcatggattgaaggcggtaaaacacgttatgatttattagggaatgccatgcaaacagcaggtatagatagcggtatgactaaaacaacatctattgcttctgggtatagtggtcaatggacagaaacgtctgctaattttaataatatcacatccactggacaattagcatttagagttggttttaatagtgcgttatattctgtatatttaagacgggatggaaccttgcccatgactggcgatctaaatcttgacggacataatattaacaatatcgctaatatcaatgctacaggaaatattacgacgacaagcgacctacaggcaagaaatattaaagctacaggaaaagttgatgctgacggtgatatttcatcaggaagatatttgattgctaaaagcaaagatgaagatgcatcaataaaaattggaggcgatggcactggaaatcataattttatgtttgaatctcaaaaaagaacatctgttgttttttttccaagcgttaattctgcattgttaacttataaatttcgtgggaatataaacatattaagtccttctggggattcagttggtgttaaattaaatggcaccactggaaatatcactgcctctggaaacatagaggccgcccaaaatgtcaaaggcgctacattagaatccactggacgcgctacggtgggtgagtttgttcaattgaacggacaggctgaggttggaaaagtgtgtcaatctaatggattacaaggaagaacagcaaaagggaaaattttatcttgtgttaatggtgtatggaccggatcggttcaaataaataatagtcaatgtaaatggttttccccggctaatgctttttcatactttggagaatacagtgggcaacttcatgaaaaacctataatttgtccagcaggatatattatgacaggatctaaaatgtggggatgggcagaagatgttgatgacgaacatgttgatatctattgctgtcctttatcctaattaaaaaaggttaaaagttaaatcccatattcataaaagattttctgaggatgggattaccatagctactcttactcacggaagaaaaaaagctgaaatgtgtattttttatattttaattttgtgagttataaactggcctcctaaaaggccagtttatataatttaaaggttgctcattatttctgtaatggctgtggctcgaacatattttgctgcattagtcgcttaaattttaactgttgatgaaatgagaaattacccggttcttgaggataatcaggaaatatatttgtctaagaaaagtgaaaaaatttctgagccaccacctttcgggtgggttatcatgaaatgtaagtgagttattcatcatgatattgtaaggctagacaactatatcttaatattttgagtctggaatgtttttggtactaaatgtgtcgttaaagataataatcatttgacaaataatagcgattataataaggaatgttaaatagttacaaaggagataagatgaatatttttgacgataatgattacgaaaaagcctgtaaatggtataagcatatcagatctaatgttgaaggttttaatgttaaaatagaaaagttaagagaaaaaacagcattggatttattaaataatgaaggtgttgattattttcataaaggttatcaatcgtttgttgagcgctttgaaaaagtttttatcaaatcatttttggctccttatttaaaggggcctttttattcatctattggtatttattcttctatatatagttcttcttccatcttgatttttgtttgttatttgataattaattaatacgtgaatataaaaatggcgatgaaaatgaaaattaaaaaaggattctctttattagagttaactcttgttttaggtgttgggacgatggtggcttttatgaagtttcaggatatgaaaaatgaacaggagagtataatggcttctgctgtcggtcaacaaatgaaacagatcggtgaagcagttaatggctatataaatatccgttatgataaattatcaaccttatccaatgctgccggaacaggaaccgatccgggtccaagaacctgttcaggttcagtatgtgaaattacttaccagacattgattaacgaaggtttgctactttcaacctacacaggcactaatgctaataaatcctcgtataaaatcatattaaaacgagatggaacttcacctaactatgttattaatggtcttataacgacatcgacggcatggattgaaggcggaaaaacacgttatgatttattagggaaagccatgcaaacagcaggtatagatagcggtatgactaaaacaacatctattgcttctgggcatagtggtcaatggtcagaaacgtctgctaattttaataatattacatccgctggacagttagcatttagagttggttttaatagtgcgttatattctgtatatttaagacgggatggaaccttgcccatgactggcgatctaaatcttgacggacacaatatcaacaatgtcgccgcacttaatgccactggcaacattacgacgacaggtgacgtacaggcaagaaacattaaggctactggaaaaattgatgcggacggtaatatctcagccggtaattggatgtgggctaagaatggatatggggacgctataggttttggtggagatggatattctggaggtttaggtcgagattatgaaataaaaatgctatctaaccatccactaacgatacattcaccaacgtctagtcgcggaaatgatgttatattagatattgatggaaatatgagggttcagactgatattagctctcttagaaacattacagcctctggaaacatagaatcatcccaaaacgtcaaaggcgctacattagaatccacaggacgcgctacggtgggtgaatttgttcaattgaacggacaggctgaggttggcaaagaatgtcaatctaatggattacaaggaagaacagcagaagggaaaattttatcttgtgttaatggtgtatgggaaactatagatgctaatttaaaaatatcaacatacagtttaaagcctccaaaacatcaacttaatatgggagttcatagtgtatgctctttaagtaatgtaaaattttataaagggaataacactccatatattagctgtgaaataataaaaaatggaaataattggctttttcagacagtttattcaacacaatgtgaggctgtatgcataaactaaatcccataattactccgcgtcacgttcgattgaatggaaaaatcccagatcttttcttttttcttttaaaagactgacatggtaattttatattacatatggagtgttggttattctattatataacattaaaaagagtggatattaaaataaaaaagtgaagtatataattttataatctcaaactatagagaaataatctggaaattgtttcataaatattaaatcccatattcataaatattttcagagaatggggttaccatagctgctcctacttacggaagaaaaaatgctgaaatgtgtttttttagatttttattttgtgaattataaaatggcctcctaaaaggccattttatataatttaaaggctgctcattatttctgtaatggctgtggctcgaacatattttgctgcattgattttttctgcttttaaagcactaaaatgcgcagttccacaggctatcttcgcatcttcttcatgaccaagaccaatgtgtttactttttgtctctacaacaaagtaaatatgttcttcaccattgtcttcaataactaacgcccagtcaggattgtaggttcccagtggcgtcgggattttaaaccatcccggcagcttcacataaagcttaacttcatcctgttcttcgagttcctgagcgaaacggctttcgacttcagaatctttaggaacgtattcgtaaactgacttagacgaggtttcaaaaagattacgggcatatcctgttagctctttatccataaagagactttgcgcatacacctctccttttagtggataatatttaataccatcaacaattgacaggcgtttgcagtagttgattcggcctatagcttcactgataaactgctgtggatttttagcaaaatcagcgagtcttccactctctttcaggatggtgcttaaactgcgtcttgtcagtccggttttttcctgtagaacaccaagaatatctggcaatggctgctctgcaacatcaactacagagcttgttgttccattagacagagctttaacatcaaggccagattgactttgtttgattgttgctttgctgaaactgaccattgcttttgctacaggctgcatttcagaaagtgatttcgtacaggatttgatcaattcttcttcatcaaatgctagccgatacagcgttttttgacaaatgcgctgccataacgcttcgaattccgggctgtttaagacttctttccggtatttgattgttttacgttcatcagcattgtttatattgagtcgccctgctgatttacgcaggatagtttcaatttgttcctgtagtgaggcatacttctcactaacaacaaaagtgttttcgaataattcttttttcagggttttggtaatttttcccgatttttcaatataaccttcagtctgaagttcagaccagatatcatgtgaaccggaaatacctaaaccttgtgaggaatcagcgaagataagatgggcgaacgcatctttttcaatcacaccaaaacgtatgcctgtttcgctctcaatttcagactgtaatcgttcagcgtaggcttcataattttcactggcaacgactgtcagaatgttaatgctgtcatcacgaacacgttcaccctcttggttaacacacaggcgaagaccacggcctaatgtttgacgacgttctcgttcacttcccatctctcggaggctacagatctggaatacattggggttatcccagccttctttcaaagcagagtgcgaaaaaataaacctcactggattcgagaaactcaaaagcttctctttatttttcataatgagattataaccacgctcagcattttcacggcctgtattattgctttcgcttgtttcagcccatgcaccttttttatcaatggagaaataaccatcatgaacatctttggcatgttctggatgagaaggaagtaaatctttataggcagggcttttgattgctttaagatattcttcttcaaagatacgggcatattcacccggttcacgtactccttcttcattggtctgacgatataaatcaaccttatcaatgaaaaacagggtaagaaccttgatttgctgagtattcaggcgaagttctttatccagatgttcacggattgtacgtctgatcatatgacgctggatgagcatagggtcaatatcccccacgacatcaccgactttcatatagtaggtatcagaaggtgtttccagtgtaagataaccctctttgccagttcggatctcgcttatccggtaaccctgataaatatcacgtcctgtttcgtcatcgagtgtcataccgtcatatacggtaatctctgaacgatttacgttcccttttttatcggctatatcaacaataacagtcgcactaatgctattcttcttattgttaatactgaccagttttacataggggctattacttgcattttggacttcaagcccggcaacctcgatctgtttgaccagtttttggttgtaagcatcaatggcgtcaaggcggtacaccatatgatgtttatgaacatgtgttgctgaatagcgtaaggtgaacatggggtgcatagcatcaagtgcggttttacccgcaccgttcaagccaccatcaacactttgcggttcatcgacaataataattggacgtgtagcacggattaaatcaatgggcttatccagatcgtccacagttgttttttcactggactgatagagcttgttaacatcttttttgttaatcgcacccacagtcattaccatgatctgcataacagaactggttgcaaaatttcgaacatccgcaggttttgccgaatcatacagatagtattcgtatggaactcccgcaaacaggcttttaaaatgttcttcagttatttgtagtgttttataaacgccttccttgatagcaactgaaggaaccacaataataaatttactcatgccatagcgtttattcagctccagcatggtgcgaagataaacatacgttttacctgtccctgtttccatttcgacagtaaaatcatggctgtcgagcacaggtgaaggtggaagctggttttttaactgaacattgttcagatttttaagcagtacatcatcttcgggtatttgtgggttaacaggcattgaacctgttgcgccttcaaatgagagtgcaccctgagctggggccagcacagtcatttcgctttcccatttctcttgcccttcaaacaaatcacagaccgatgttatggcgttttgctgataggtaaggtcagattcaaaatgtagtttcatctcattcccttacaggctgtgcaggttagtcaggccatgttgttccagaatggcgcaaagatttgttttagcaacgttattttcaaatgcgtcatcaaggaaatagcagaccgtatctttgccagcttttaaactcttataccagtcgatgatccccttggtcagttcttctactgaagatgcagggatttgtttagcaaagcaggtaaacaatttgccaccgtcaacacaagaaacggttaatccatcaaactgacgggtttcaatgtttacactcaggtcaatgccacgtttgagcatcaactctgtgagcagatcttcttcattacggccttcaaggattgggcttacataggcatcaatctgttctgaaagggtttctgctgtggcttcccacggacggatattagatgtatcgagtttgaaaacacgaaaaccaacatcaccattccagtcaggattatcttcacgaacctttttacctgcacggcgtaggcgctcttttgtgatttctgatatttttaaagacattccatgcttcttcaaaaaagctgctgcaatggcttgttccttagtgttttcgtcaactaattctggtagttgcgcaatcacaaatttgattttcctattcttaattgcattggctgtgaaaacagcgtgaccaaaagttcctgaaccgccaaaaaaatcaagtgctatgcattcctcattagggtaagtagctatttctattatgcgaagaagagtgcctaaaggttttggtctagaaaaaacttctttgtcgaatccaatttcaataaattgttcacttcctctttcactatttacgtctctatgtgtccatgaggaggtggcttttaccgcatcccttttggatagatagtctttctccatgatgccccacatttttttagtaggcataaatttagcgtatacactctcgatttttgtttttgctgtatcaaatccccatctccatcggccatccgtaccatcatctcgaataggttttatttcgataagaccatcatttttttgatctttagagacagataatttgttttttacttcatcatagtagaaataataaaacatatcaggtcgatcttgtcttcggtccgcatcacctgttttacgtaaatccatatcacgaaagacttcacctgcttcatcaatcttattatatctttttaggattttatcatcaggttcaaacccataagttttagcatgggttatattttttgtcattacaagtatatattcatgagcagttgctatgaatttatcatcagagcgacctttaggattgtttgtattagctataagagctataaaattctcttctccaaatatctcaaaacataaactacataagttatggacttcatgttcgtcgattgaaataaaaataaagccagagtcagaaagtaagtttctggctaattttatacgggggtacatcatattcaaccaatcggtatgataacgaccactggtttctgcatttgtacttacccggacaccttcttctgtttgccctgtgatttcaagataatttttcatattatcttggaagttatcaggataaacaaaatctttcccggtgttgtaaggaggatcaatatatataagcttaacttttccagtgtagcttttttgaagaagctttaacacttcaaggttatcaccctcgatcatgaggttcttggtgttatcccaatcaacgctttcatctttacatgggcgtaaggtgccacgggaaggggtaagagcaagctgacgagcctgacgcttaccatgccagttcaggccatagcgttcttctttttcgtctacattttcacccaaaagctgttttaaaacgtcaaaatcaatgccgttttcattaaaggcttcaggaaacaatgatttaagcttggtgatgttatcagcagtgatattcattgattgcagttcgggcatttcaggcgaaagtttgttcattgaccattccacgtatctgtatcaggttactgtgtgatgggggatattttacggtaaagagtgcatttcatcaatgaacagcgtgctacagatttctttttaaatcattatgttaatgcttttattgaatgttctgtcctcgtgttagtacaattagcttttctgcgtctaccaaacattatcaggatgtgatgatggctaaactgaacaagaaacaactttctttactcaaggaaatgcctgcagaacaactcatgcaaataatttgtgatattgcagaggataatggtcaggcaaaatcctttcttattaatgaatatctgttaactccagaagaatcactgaaaaaggctgaggctgaatacaaaagggtaattaaaacaaaacgcttttatgattattatgaagcagcgattttttttgaggggctatacaggaatgtcatatttccacttgaaaagacggtatcaacgctgcctgaaaaaaccgaggcgttttgccatgatttactgctctcatttgataaagtcagcgaaattgctgatacatcagatggatcatggatggactattataatggtgctgtcgaaatatggttaaaatccctgtccctacaaaaagacaaaagtattgatgttatagcggataaaataatttccgtacttaaaggtgatgtgtattttaactttgatatttttgataagtataaaaaagaactgggatacaatgttattcgtgttttaagggaaagtcttcttaagacaggtgatgtcaatggtgctgttgagttaagtctgtatatcagggatgttgatttcatcaggcaatgctttgagaaaagaaaactgaatcagccagaatatatcattaagtttgctgagttgctggttgatgaactgtgtactgaggaggccattcaggttctcaataaaatcaaagaagataaatcagttgatcaggcagggcttcgtgataaatggactgaggtgttggctctggcgttgattgaagaaggcgagattcagcaggcaaaaacaatttgtatagacggatttaagaacaggtgtgatgttattttttataatatctataatctggtggagaaaaataatgactcactggatttgttctctggcatagcaaagaaaaaaggctttccgtttgttattcttttcttgtccgggacagatagttatggaaaacttgattctgaagtcatgaatgcgagtgaaaatgaaatcgcagagatgatgtctttattacgcggttcttttgttcgtaccttatcgagtgagctttacaggcatggttatgcatgttctgcaactctgctccgtagagtgctggcagaggacagtatcagtcgttctcagagtaaatactacacctatgcggcatctgatatgaaaaaaagcattgattacagtaaagatattgcatggactgaaaaaatcccttcaacagaagagtatttaaaatctctgtttattgagcacaaaagaaaatacgcactctgggaaataatgctggaaaaaatcgctggtttagcgatagagaaagattcagtatcatattcagcatagactgtaattaagcatgaagttgaaaggccgcgaacggcctttccctttatttatttgaatcaaactcaaacggcctgaccatatcgttgctgttagcatcaaggaaatcagcccaccactggagcatcaggcggcgctggtcaaggtgttttgccttgtgggtataagcagcacggacgctattgctttccttatggctcatttgaagctctacagcgtcttctgaccatagcccggactcaattaaggcactacaggccagagtgcggaaaccgtgtccacagatgtcctgctttgtgtcatagcccatattgcgaagcgctttgttgatggtgttttcgctcatgggtttaaacgagtcataacaaccagtaaagattaatccgtcatcatgaccttcttcataagtcagttgtcggatctctttgagtatcttcatggcctgcttacaaaggggaactaagtgcttacgcttcattttagccccacgagttgaatgtttgacgttttcaatcgcttcacgctgttcgggtatcacccataacttacttttgaaatcaatttctgaccagcgagcgaaacgcagctcactggaacgaatgaaaatcatcagattgagctgtattgccagtatggttaacctgcggcctttgtattcggcaattttgttcagtaactggggtatttcttccagctcaagtgcagggcggtgttcagtttgtggtttctgaactgcaccttccatatcataggctgggttatggcgtatcagcttttgctggacggcatgacgcaggattgccgtaatgtattgttgaatgcgcatggcaacttcaagataaccaagagcctcaacttttttcaccggaaccagcagatcacccgtatccagttcggcaacatctttgtcaccgattaccgggaagacataagtttcaaggcgcttccatacggcatcaccataatcatcagaccattttgttttcgtggagaaccacgctttggctactgttctgaaggagcgtgtattatcacgtttggctttaagctctttaacctctgcctgtttctttgcattagggtcaataccctgagcaagaagccttctggcctcatcacggcgctgtcttgcgtcagaaagagaaacagcagggtaaacaccaatagagaagagtttttgtttcccttcgaagcggtaagccatttgccagtatttcgaacctttaggggtaacacgaaggaacataccaaagccatcagtaagcttgtattccttctcaaggggttttgcattttttgctttaatatcagtcagtgacatgaaaacaccccctcatttgttggtaaaagggaaatcgaaccagcattaccagcatttttaccatcaaaatgatatggcttcgagtggtttttagtgaacgagggtgaacgactgagaggggataaccaattgatagaaatgcagaaagcagacgttagtgaacgtctgctttcttgaaaatggctcctctgactggactcgaaccagtgacatacggattaacagtccgccgttctaccgactgaactacagaggaatcgtgtgaacggggcgcatagtaacgatgtgcgatcggcttgtcaaagggggaaataagattgcgcgtttgtttgctgacaaaaacaacaaagcgttgaagttttgatctaattcctactttgccccggcatggcgcaactttgtctgtcattgcacaagtcaaatgctgtgaccttaccgcaatggctatgtaccagcgcctgatgaggcgtgaaaaattggcaggcacttggcaaataattctgagacataacgccgtagagattaagggcagggggcagaatgaactttagacgtgaaatattttgtgaaaatggttgatacaggcagtctgacgccggtagcggaaatggcagataaatttctggtgcaggcgaaaagatttccgtcaatatcacaggcagaattatggcaaaccagctttaccagcaaaagggtatggcttcgagtggtttttagtaaacgagagtaaacttgaagaaggggataatcagttgatataaatgcagaaagcagacgtcagtgaacgtctgctttcctaaatctggctcctctgactggactcgaaccagtgacatacggattaacagtccgccgttctaccgactgaactacagaggaattgtttcaacgaggcgttgaatactgggccggctataacgtgtcaacagtaaaattaacgcgccaattcaattggttaattaacccacaaagtgaggaattaatgttcggattcctcgccgtagtcgccttcggcagcgcttacccgtaagcgctgagaaggatcctggcgatagaactggcaaaaacgctgccatagcgccgggaaacgtggagcaaacagttctggcgcgctgaaaaaatactctgacaacacggcaaaacattctgcagggtcggtggcggcataggcatctatactggcagcgctttcgccaacaagatcgatttcatcctgaatattattcattgccgcgtggagatcgtgttcccagccagccacatcgcgtaacgggatgaaagggatgccgctggcgcgatcgccattacgcatatccagtttgtgcgcaacttcatgaataatgaggttgaaacccgaagcatcgaacgagtcctgggtatccagccagttcagaatgatgggcccttgttgccagctttgccccgactgtacgacacgctggctgtgcaccagacctatgtcatcttcccattcatcatctaccacaaagggcgcgggataaatgagcacttcatgaaaaccatcaagccactcaataccgagctccaggatcggtaagcaaaaaattaacgcaatacgtgcactttttaacgagtcgagctcaaatccctgtagcgctaccagtcttttctgctgcaaaaaacgttcggctagcgcaataagccgagcctgttcttgcgcggtgaggtttaccagaagaggtatagccagcgcatcatcccacggccagtcttcgttctgggttatttcttgtgctttccagggccacttaatcatcgttttgctcgtaaactcgtcacttgaacaaaattacccgaatagggtctgttaaaatgccaaattacctggcatcattgcaatatacggagagatgccggagcggctgaacggaccggtctcgaaaaccggagtaggggcaactctaccgggggttcaaatccccctctctccgccacaattcaaacacttagctcatcttctttcagcgatcagtctcacacttagaatacacttagagtattctgttagaatattacgtgaaaaacgtatcgccatcttatgctttttctgccagaagagggggccagggatggtgttatttttacttttcgatcataagtcaactcctggttttctgccccgctatttcgctgtaccccatcgggattcacagtgatgtcacttgcggcgacttaacgccgtcgtcctcggtaatcgtcgcacccggcctgttgcccgaaatgttcccctgtagacatgggcgccgggcagaagattaattgctgtcagggaaacgcgctggcgcgtggcgataacttacgctgcgggactgtcgacgctgtacagaaaatctggcctccagactggcttaaatatgcacacatgacaatacaaccggaaaatttacaaaacgcataatttgaactgagagagaaacttacaaacgaagcgacgaagatttaaacagtcgtagcgactccggtatcttgcgcgcatgttcaaataacactactgtatataaaaacagtattcgaggtatggattatggaatttttcagacctacagagttgcgcgaaattattcctctcccatttttcagttacttagtgccgtgtggattccccagccccgcggcggactatattgagcagcgtatcgatcttaatgagttgctcgtttctcatcccagctcaacatattttgtcaaagcaacgggggattcaatgattgaagcaggcatcagcgacggtgacctgctggtggtggatagctcacggaacgctgaccacggtgacattgtaattgcggcaattgaaggagagttcaccgtaaagcggttgcagttgcgtccgacagtgcagttaatccccatgaacggcgcctatcgacccatacctgtcggcagtgaagacacgctcgacatattcggggtggtgacctttatcattaaagcggtcagttgattatgttcgcgctctgcgatgttaatagcttttacgcctcctgcgaaacggtctttcgtcctgatttatgtggccgaccggtggtggtgttatcaaacaatgatggctgcgttatcgcgtgtagcgccgaggcgaaacaactcggtatcgcagcaggtgagccatacttcaaacagaaagaacgcttccggcgatccggtgttgtttgcttcagcagtaattacgagctttacgctgatatgtcgaaccaggtaatgaccacactagaggagatggtgccgcgggtagaaatttacagcattgatgaggctttttgtgatctgacgggggtacgaaactgccgggatctgacagatttcgggcacgagataagagcgacggtcctgaagcgcacgcacctgactgtcggtgtaggcattgcccagacgaaaacccttgccaagctggctaaccatgctgcgaaaaagtggcagcgccagaccgacggggtggttgacctgtcgaacatcgatcgccagcgtcggctgctggccctgatacccgtagaggatgtctggggtgtcggcagacgcatcagtaagaagctcaatgccctgggcatcaagactgctctcgatctctctgaacaaagtacctggatcatcaggaaacacttcaatgtcgtgctggagcgtaccgtgagagagcttcgcggagagccatgtctggagcttgaagagtttgcgccggcaaagcaggaaatcgtttgtagccgctctttcggcgagcgggtcacagactatgaggaaatgcgccaggctgtttacagctacgctgcgcgcgcggcagaaaaactccgcggcgagcaccagtactgctgtttcatttcaacattcgtcaaaacatcaccctttgccctgaacgagccctactacggtaacagcgccgcggtgacgcttctcacccccacgcaggattcacgtgacattatcaatgcggctgtgaaatgtctggataaaatctggcgcgacggccatcgctaccagaaagcgggggtgatgctgggtggcttcttcagccagggcgtagcgcaactcaaccttttcgacgataacgcgccgcgcgccggtagtgcgaagttgatggaagtactggaccatcttaacgcaaaagacgggaaggggacgctgtacttcgccgggcaggggatgtcgcaacagtgggctatgaagcgagaaatgctttcgcctcggtacaccacaagatactctgatctactgcgtgttaagtaacttgtgcgatcaatgcctgagatagttgctaaatcgtccccgttcttttggtcgcacaagatcacaggaacctctcacgataatgcgcatgtatcctggtttacgacatcaggaaatgtggcgcgtttattgccaggcaggcgttgtgagacgtaacttatttacgcctggtttcagccgtagcgatgggcatggataaaaagagtatggcaatcagcgtgataatgctaaaaaacaattaatatttttttaacaaaactaaagcttgctatgttcagttaaccatgcgttaatggttgtgcggtttgatacaaacttatctgaagtagtgattgtaatatttctcatcatttgttcctcttgagatctcctttaggtttttttctctctgataattttcttcaggccatttcgcccaagggctcattcaaaaggtaacaatattatgacgacgaaaatcactggtttagtaaaatggtttaaccctgaaaagggctttggtttcattacgcctaaagatggcagcaaagatgtgtttgtgcatttttccgccattcaaagtaatgaattccgcactctgaatgaaaatcaggaagtggagttttcagcagagcagggaccaaaaggtccatcagcggtcaacgttgtggcgctttaaggcaactgatattactaataaaattcacttccggtgtccatgttgccatggttcacaatacagaacatcgacattcgatgttactgagcaaaacccgtttggcgcgaaatgtattttttgtaagtcaaccatgatcacttttgataatgttggattatacattcgctcaggacaggttccgctagattttagaaaataattcatattagctccgtacaggagctttttttatgcccggatgattatcatctatagacgctgacatccatcatctatagtggcatttacctttccccaaaggtgttatttctcttgcagacagcgcctgaaaagagcgacgttgtcttcatctatccgatgaagcctggtcacctgtctttgcgccgttatccgttatttaattcttgccctataataacaagcccgcgctaagcacgggcttgaataacataaagcgtcttagaactggtagaccagaccaacacctacgatatcatcggttgcaataccgttgtttgcgtagaagtcatcatcttcgtccagcaggttgattttataatcaacgtaggtggacatatttttgttgaagtagtaagtcataccgacgtcaacatatttaaccagatctttgtcggtgtaacgccagttgccacgatggacttcctgaccgcctaaatctttgcccttagactgcaagtaggcgatggacggacgcagaccgaaatcgaactggtactgcgcaaccacttcaaagttctgggttttgttagcaatactgccattaccttcgccattgccgccgccataataggtcatgttgcgggtttcagcgtacatggccgccaggtaaacattgtaggcgtcatatttggcacctatggtccaggcttcagcggtttcaccgccggcatagttgttgcgctcattcatgccgtcgccataaccacgagcaacctgattgtccgaacggtcagaggaagagtaggccgcacccaggcttaacccgaagtcaaagtcgtaggaggtagacataccgaaaccgtcgccgttttcacgggccagtttgcggttgccgccgttacctgtaccttcaccagcaccagcaccgccgttttcattattaccctggtactgcaacgcgaagttcaggccttccaccagaccgaagaagtcggtattacggtaggtggcaacgccgttggttctgcccagcatatagacatcggtctgggtataagtatcaccgccgaattccggcagcgcatcggtccaggcttcaatgtcgtagataacaccatagttacggccataatcgaaagagccgtactcgccgaatttcagaccggcaaagcccagacgagtccaggagtttgcaccttcgccttcggtggtgttcaccttaatgttgtattcccactgaccatagccggtcagcatatcgttgatctgcgtttcgcctttaaagccaatacgggcgtaggactgatcgccatcgtcgcctgcattgtcagagaagtaacgcagaccatcaactttgccgtacaggtcgagtttgttgccatttttattataaatttcagccgcatttgctgcgcctgccactaataacgccgggacaagcagtgccagaacttttctgttcattatgtattcccttatgataataatttatatgaatatgtagccacttcaacaaaactacaaattgatactattctatgaagttcatggaatttaaaaaataacatgtaacaaagatatttaaaatatttcaatttgtttctatttggttttttataatacaggatatataagtgactaagaatatatagtctataattatcattttttatcaatgagttatgtgttttgatttgatggctgctggcgtgaatataatttgttttttatatgtatttgatgctttgattatgaaaaagcataaaaaaaaaccggcataaatgccggtaatgtgggtaatgataaaataaatgataaaaggctaataaccgaatcattctgacatttaatgctaataaaataaaacgctatcgcggtgcgtaaaaataagttgttctggttatgggttattctgcatcagagtgcgattcaattaccattcccttatttaacagcaggttcagcgccagacgcaacattaactgagaataaactatttgtggaatgaataaccagaacaggtggataaggtattccatggtcgaaatgtgactaatatcacattataatgtaattaatgtcatatgacttacatcacaaaagcggagtaaagtttgagtaccagggaggacaacgccacccgtagcatgggcggtaaattagcgttatgggttttttataccttttgcggctacttcatctgggcgatggcgcgttgcgtgtggctgatgtccgccatacaaaccgagccggttctcggcccaatcagcactcctggcagcgcaacggaaaaatggcttaacgcgctttcgctgggcgtcgtctggcttattctggggagtattgcctggtacacccggcctcgcaaaaacagggggtatcccgccgacactcagccagaaacgcgcaagcacgcaaggatgtaaagtggtggcggatatgtcaggatagcgaaccctgtgctcaggcatgtaataaaaatggtctgctataaagagagggcgtatggactcaggatactggcaatcgcagtttgaagactggctacgtcaccaccaccaggaacaggatgccgcccatgacatcttccattttcgtcgtgtttgggcaaccgcgcaaacgctcggggaaaacagtcctgtcgactggctggtggtgctatcggcatgttatttccatgacatcgtcagcctggcgaaaaatcatccgcagcggcatcgttcttccattctggcggcggcagaaacccggcgtatttttctgcgggattttcctgactttccggcagaaaaactggcgggcatttgtcatgctatcgaagcgcatagcttcagcgcaaaaattgcgcctaccacgccagaggcaaaaatcgtacaggatgcagacaggctggaggcgttgggcgccattggtctggcgcgggtcttcgcggtctccggcgcgctgggcgtcgcgctgtttgatgccgacgatccctttgccaacagacggcctcttaacgataagcaattcgcgctcgaccattttaaaaccaaactgctgaaactgccgctgacgatgcagaccgaacggggcaagcacctggcgcagcgtaatgcggattttctggtgtcgtacatggcgaaactgagcgctgagctgaaaggcgactatgaaacacgggatgatgcggtcatccagatgtttgctacgtatcagtaacccctgccgctgaaacgtaaaccgcgtcattttatgttagtctgtcggcaattatttttggccggttaaatgtatgcaggaaaatatttcagtaacacacgcccggaacctcatcgccgacgacgccggaagcgagatccaggcgatgctgagtcaattgctggaaatctacgatgttaaaacgctggtggcgcaccttaacggcctgggcgaacagcactggagcccggccatcttcaagcgcgtaatgatgaacgcggcatggcatcgtttgagcgacaatgaactcagctgtcttaaaacagagttgccgacgccgccagcgcatcatccacattacgcctttcgttttatcgatctcttcgcgggcatcggcggcattcgccgcggatttgaagcgataggcggacagtgcgtgtttaccagcgaatggaataagcacgcggtacggacatataaagcgaactatttttgcgatccgctgcaacatcgctttaatgaagatatccgcgatatcacattgagccaccgggaaggggtcagcgatgatgaggcggcggaacacattcgccagcatattccgcaacatgatgtcctgctggcgggctttccctgtcagccattttctctggcgggcgtttccaagaaaaatgcgctgggccgcgcccacggctttgcctgcgagactcaggggacgttattttttgatgtcgtaagaattatcgacgcccgccgccccgcgctgtttgtgctggaaaacgtgaaaaaccttaaaagtcacgaccagggcaacaccttccgcattattatgcaaacgctcgatgaactgggatatgacgtggcggatgccgctgacaatggcccggacgatccgaaaattatcgacgggcagcactttcttcctcagcatcgggaacgtattgtgttggtgggattccgtcgcgatttaaacctgaaaaccgattttacgttacgcaatatcgcccgttgttatccaccgcgccgtccgacgctggcagaactgctggagcccgtcgtcgaagccaaatatatcctgacgccggtgctgtggaaatatttatatcgctacgcgaaaaagcaccaggcgcggggaaacggttttggctatggcatggtttatcctgacaatccggaaagtgtggcgcgcacgttatctgctcgctactacaaagatggcgccgaaattctgatcgatcgtggttgggatatggcgaaaggcgaagtgaatttcgacgatgctggcaaccaacaacatcgtccccgccgactcacgccgagagagtgcgcgcgtttaatgggatttgaggcgccgcaaacgtaccagttcaggatacctgtctcggatacgcaggcctatcgccagtttggcaactccgtggtggtgccggtatttgccgcggtagcaaagctgctggaacccaaaattcaccaggcggtgacgctgcgtcagagagagacggcagatggcggacgttcacgataaagccacgcgcagtaaaaatatgcgcgcgatagcgacccgcgatacggcgattgaaaaacgccttgctggcctgttaagcgcgcaggggattacgtttcatactcaggacacgacattaccgggcaagccggactttgtggtgaatgactatgattgtgtgatttttactcacggctgcttttggcatcatcaccactgttatctattcaaagtaccggccacgcgaacggctttctggctggaaaaaatcggtaagaacgttgagcgcgatgagcgtgatattcagcgtttacaggcgcttggctggcgggtactgatcgtctgggagtgcgccttgcgcgggcgagcgaaattgagcgacgcggcgttggcggagcgcctggaagagtggatctgcggcggcggcgccagcgcgcagatcgacacccaggggattcatctactggcgtgaatcttccgttttacacggtgtgatcaccgccctggcgggaaacaggtacttacccagagtcactagcactacggcaaacacaatcacgcccagcgcggcccattcaacgggcgataacctctcaccgcctaggccagtgccaagcaacacggcgacaaccggattcacataggcgtagctggtcgccagcgccggactgacgttgcgaatcaggtacatataggcattaatggcgataatagaaccgaataacgccaggtagccgacggccataaaccccgataaaccaggcagcgtggcgagcttttcgccggaaagaaacgccgcgcaaagcaataccacgcccgccgccagcatttcaatcgcgcccgccatcatgcccacaggcagggcgatgcgcgagccgtaaacggaaccaaatgcccagctcatcgaacctatcaggatcaaaatcgcgccccacggattgccgcttaaattaccgccgctgttcagcagaataatcccggcaagtccaatggcaatccccacccattctaatttgcgcgttttaataccaaaaaagtagctaaagcacagcgtaaatagcgggacagtggcgaccacgacggcagcaatgcccgatggcacgttttgatgctccgccaccgtcaccagaccgttacccaccgccagcagcagtaggccaatcagcgcggcgttgatggtctggcgcagcggcggaagtttttcgccgcgcaacagcaaaaacgccatgagcaacatccccgccgagagaaaacgtacgcctgccatcattagcggcggccagctttcaacgcctatgcggataacaaaataggtagacccccaaatgatgtacaaggcaaaaagcgcgccaaaaagaggtaataactgccggaaacgcataatcactcacggtgaaataaaaagggtgaatatagtaaacgtcaaaattattatgctggcgagcattataattgtccttttggaataaaaaggcgttgacccgcgccgccggtttcggcattgcgcgttttgctacatacttaacgtcttagaagaaaagaccgaggaaatcattttggcaggaagtagcttactgacattactcgacgatatcgccacgctgctggacgatatttcggtaatgggcaaattggccgcgaaaaaaaccgcaggcgtactgggggacgacctgtcgctcaatgcgcagcaggtgaccggcgttcgcgctaatcgcgagctgccagtggtatggagcgtggcgaaaggatcattaatcaacaaggttattctggtgccgttggcgctgttgataagcgcatttatcccgtgagccattacgcctttattaatgttaggcggcgcgtttctctgctttgaaggggtagaaaaagtcctgcatacctttgaggcgcgaaaacacaaagaagacctggcggagcggcaaaaacgtcttgaggcgctggctacgcaagatcctttggcctttgaaaaagataaagtaaaaggggcggtccgtaccgatttcattctttccgctgaaattgtggcaattaccctggggattgtcgcgcaggcaccgctgcttaatcaggtgttggtgctggcggggattgcgttggttgtgaccattggcgtgtatggcctggtgggtattattgtcaaactggatgatatggggtactggctggcggaaaagcgtagcgtgctggcgcagggcgtcggtaaaggattactgattatcgcgccctggttaatgaaagcattatccattgtcggtacgctggcgatgtttctggttggcggcggaattgtcgtacacggtattgcgccgctacaccatgccattgaacattttgcgcagcagcagggggctttcatggcgcatacgatccctgcggggctgaatctggtgctcggctttattatcggcgccattgtggtggcgctggtgaaaggtgtggcgaaaattcgcggtgtttcgcactgattttctacaatgaattatgcaaaattgtccatcctcgtctaaggtgaaaacgtttcatctgatacaggaggcaggtatggtcttttctgtcagtgaggaagttaccgtgaaagagggtggaccccggatgatcgtcaccggttattccagcggaatggtagagtgtcgctggtatgatggttttggcgtaaagcgggaggcattccatgagaatgagctcgtgccaggcaaggaaaggcgcgtgcgggatgaagcccgatgacaaaacgcccggttaatgccgggcgttttgctgtggagaaaaagagtcgtcgcgctgcgacatgctgctacctggttatgccaggattgagtggtatcccttgatgaggtctggctaccgtaagccatcagggggcgttgtatcaataaccaggagttaccagggtgccgcacgaaacactgttagacaatcaaggctggtttaaaaagctggcgcggcgttttggtcccggtcatgtcgtcaacacctgttttctgatcgtgatgctgttctcgacgctacttacctggcgggaagttatgatactgaaagacgcgtatgtcgccagtcagcgcaatcatctggggagcgtcgcgaatgtccttgaccgccaactgcaattcaacatggacaggttgatctttttacgcaacggtatgcatgaagcgctggtggcgccgctggctttttccgcattgcaaagcgcggtgacgcagtttgagcaacgacgcgtcagacatttctggcaactggagttggataaacggcggacattgccgttatatggcgtttccgatcaatttgtcgcccggacgacgcttctttcgcgggagagtcgtgacctggcaaatgaattaaccgccacgctggagttagggtatctggcgcgctcatccgccatgctgacgctggagacgatgtatgtttctcgctcagggttttacctctcaactctccctacggcgtacggtagcgatattgtttcccgttactatcagtacgtgacccagccctggtttatcgagcaaagccaacggcgtaatccacagcgcggcgtgcggtggtttacctccgcacagccctatgttgctgacgagcagaaaaaagtgacagccagtctaccgctggatcacgataattactggtatggcgtactggcaatggatattcccgtcgcgtcattacagcagtttctgcgcgatgcggccgaaaaggatattgaaggggaatatcagctatacgataaccatctccgtttgttgacggactccgcgccggaacaacaaaccgagaatacgttaaatgaccgtgagcgcgccttactggcgcgtgaaatagaaaaagataccctgggcgggctgcgtttaggaacgcattatgtaagctgggagcggctggatcattttgatggcgtcctgctgcgcgtgcatacattacgtgaaggtatacaagggaattttggcagtattagtatcgcgctgacgctgttatgggggctttttacggcgatgctgttgatctcctggggcgttattcgacatatggtcaaaaatatgtttgttctgcaaaattcgccgcaatggcaggcatggcacgatccgctgacccggctatataaccgtggcgcgctgtttgaaaaagcgtccaggctggcaaagcgctatcgggaagcccgccagccattttctgtgatacagctggatttagattattttaaaagcgttaacgatcgctttggccatcaggcaggcgatcgcgtgttgtcccatgccgctgggctcattggcagcaccattcgagcgcacgacatcgccggacgggtagggggcgaagagttttgtatcgtgctgcccggcgcgacgaaagcgcaggcgctgcagattgccgaacgcatacgccagcgcattaatgacaaagagattctggtgacgaaaagcacgacgcttcgtatcagcgcgtcaatggggatcagtagcgcggaggaatacggcgactatgattttgagcagttgcagtcgctggccgacaaacggctttattacgccaaacagtccggacgtaaccgtatttgcgccagcgacgcgactcaggagcgggaaaagaaatagtccattccttcgcgccagccatccggcccttcgttctggctacggtagacgcgctgaggatcgtcgttacgcaaatgtacaccctcccggtttagccctttaacgacaaccgcataatccatcacatccagtaagggcgcatcattggggccgtctcctagccccaacgtcagaggacgcgcgcgccactgccgacgatatgcttcaattagccagttggcagcctgatctttaccggcggaggcgtccagcacatgccagaaacgggcgccatggacaaattgcagtcccaggtcatttaaacgggcgacaaactgcgccatgcgttcatcgctatcgcgccagatcagcgacaccgacgcttcatgcagacgggttagggcagactgtgcccggtttaggcccgtccattcgcttatcacctgatcgtcaacgtcatcaaacgtggtgaacttaaactgttccttttcacgcaacttatgcaggacgaggcggatttcgttgtgagaaataccggctatcaggcggggatagttgggatggtcttcccaatgaacgtccagttggatcaccgcgccgttttccgcaatcagcggcagtccctgtagatttaacgtcgtctggagctggagcatttcagccgcggttttactgctacagaggatcacaggcacgccgctttcatgcaggcgtgtaagccagggggccgcgggctgccactcaaaagtgtggctgttcagcaatgtgccgtccagatcggtaaaaatcagcaaggggtcatggattgagagcattttttcctcattttccgttgcaacggcgggcttatttccaggaaaaatcctaaagcacatccgaaagaagtcgaacgctaactggaaccgatcccgtcgcttccaggcagcacatgcgttgtcacacttttgctaccgaactattagcgcgcttaatcattcatgtaaaaaatatttacttgtcatgcaaaaaaattgcagataaagtaaatctcacatcagatttcctggtgtaacgaattttcaagtgcttcttgcataagcaagtttgatcccgacccgtagggccgggatttttttcggccatttttaacggtttacttctgttacactaaaatcatgaatatccagctcgaatgcttcagctaattcatgccatgtatgatattcccgtccgtctacgctcacccgctcaggatcttcctggctacggtgaacctcgctttcgctgatttcattgatggccgccagtagcgcatctacatcgacgctcacttcgcgcttggccgtatcactgtactcttttgccgttttcatcttcactacctcacgggttcctgacagcctaagtatagaccgttgagaaaaccagcaaacacgccggcaaggcgctgtcagacgcagaaaattgttctacactggcacaaagcgacaggaggaaaatgatgaaggtgaatgatcgggtaaccgttaaaacggacggcggtccccgccgaccgggcgtggtactggcagtggaagaatttagtgaaggcacaatgtacctggtttcgctggaggattacccgctcggcatctggttcttcaatgagtcaggtcaccaggatggtatttttgtcgagaaggcggagcaggactaattgagccggactggaggtacattgccagtccggatgtctcagcgcatgttagcaaaaatgccgttagtgacgttatctgtcagccgcactacgtgatagatcacttgtttattatgcgtttttatctttctttttatattccccttatgggaggatactgtttttgctttaatattcattctgtcagaaatctgaatggttccctgaccttccatccacattcgtaacatgctggattcagttcgacttaacgataatgttggtaaatttatggttcctgaaatacccgactcttttttcagaatatcgccaagaagggtatccagcgagtcaggtttaatcgatttagagctaatcaataagttttttcttactaataaatattcatcaaaatgcacattagcaattgccataaaaacaataaataacgtgtcaggatgctgattaatgatttgctttatttgttgactgtctgaaggcgtatgaatgaaacagtcctcattaataaacaccaccgaaggctgatgtgcgccacaagcgatagcgagttcgtcaacggtttcgatgtcgttgatttccctttttttcacccctctgctgaccagatacccgcttaaccctagccgggtgtaactgcataaatccataataatcgttgacatggcataccctcactcaatgcgtaacgataattccccttacctgaataactcaccataatcagacggaacacgaatagtcaccttagacaacgcttacgcggtttttcaggcgaacttactatcccgtaaagttacatataatttgccaggaatcatcttaaagtaaagtgaatgttgcgttatgtgagtgaagtaaaaacaaataaggggcagcggatatatcctggtgaatgttttttaaaatttattttcggataaaccttagtaaaacaggataaaaattatgggttattatttatcggcatctcgctaacaatatcagcaagcaaattgaaaatttcgctgaataaatgttcgcaaaacggcgcaattaatggcattagcgcggccatcagcataatgccgacggtgagggtaagcgggaaaccgataacaaatatcgagagctgcggcgccatgcggtttaatagccccagcgccaggttgagcgtaagcaggagggtaatgaccggcaatgccagcatcagtccgtttaagaaaatgagccctccggccctggcgagcgccataaatgcattactgttcaccgggttactaccgatgggcagagtatggaaggtatcgaccagcagcgaaataagccacaaatggccattaaaggtgagaaacagtagcatggcgagcatatccataatacgcgccagaaccggcatattcaagtggctgcccgggtcgacgaaggtggcaaaggaaagccccatttgcagaccgataaactcacctgcggtacgcaccgccgcaaaggcgaattgcatggtaaatcccagcgcaataccgatcagaatttgttgcatcgccagccataaggcggcaatagaaaaaagcggcgtatcgtttgctggtagcgacggcgcgataacgagggtaatcattattcccaaccccagttttacccgcttgggaatagcgcgctcgctgagaatgggcgccgttgaaatcagcgccagtacgcgcagcaaaggccagaaatagagatgcagccagtatagccattgctcgcttataacctgtatcatcgttctgtttatccgatgatataaggtaaattgctgaacagagtgcgtacgtagtccagcagcaggttgagcatccacgggccggcaacgataattgcgatgaataccgcgacgattttagggataaacgacagcgtcatttcattaatctgagtcgcggcctgcaagatgctgataatgaggccggtaatcagcgcgacgagtaacagcggcgcagccagggcgagagcaactttcatcgcctcggtccccatcatcatgacggattcaggagtcattttgcgcctctaactgtaaaagctttgggccagcgaccccacaagcaattgccaaccatcgaccagcacaaacagcatcagcttaaacggcagggcgattgtcgctggcggcaccatcatcatccctaacgccatcagtacgctggcgatcaccaggtcgataatcaaaaaagggatgaaaatcgtaaaaccgatctgaaacgccgtctttaattcgctggtgacataagcgggcaggaggatacgcatcggtactgcttccggtccctgtaacggaccgctattggccagacgggcaaacagcgccagatcggcttcgcgggtttggcgcagcatgaacgcgcgtaacggttgcgcgcctttatccagcgcttcctgcatagaaattttctgctcgctaaacggctggtaagcatccacgtaaatcttgtcaatgacgggcgacataataaaaaaggtcaaaaacaacgccagtccgagtaacacctgatttggcggtgccgagggcgtgcccagcgcgttacgcaacaagccaaaaacaatgatgatacgcgtgaagctcgtcatcatcagtaaaatcgccggcagaaacgtcagcgaggtgatgaaaaccagcgtctggacggataatgaccagctttggcctccgcccgctaatggttggctgataagccccggcagttgcgcagcggcggcgggactaaaaagccacagacccgccagagaaaggaataacaaacggcgcatcaggatctcccggaacgcttgagtaagctcttcatcatgttctggaaatccgccggtggggcaacgggtgcttccgtgtcattctccgcgggcgggagggtgtgcagcaggttgatctgcgaggcggtcacgcccagtaccaggcgcgcattttcgacctcgacaatcaccacgcgttcgcgcgggccaagcgaggcgctggctgacaccttcagtccccggacgctatttccttttggcgcgaatcccatacgcttaatcacccaggccgccgccagaatgagcgcaataatgccaattaatgcgccgctcacctgcatgagcggcgatccggctggcgcggtgggctgagaaaccgtggcctctgtcttcatcattaacgactcaaacgacgcatacgctcggatggcgtaataatatcggtgatacgtacgccgtatttatccgccacgacgaccacttcaccctgggcaatcaggtagccattaatcaggatgtccagcggctcgcccgccagcccgtccagcgcgacgaccgacccctgcgtcagacgcagcagttctttaatggtcattcgcgtgcggcccagctctacggtcagtttgaccgggatatccataatcagatcgatatcctgcatagcaccgctgacatcgccgccgccaagctgttggaaaaccgcgtcggcggcgcttttattggtggtcgcttttttctcgtttaacgcgtcagcccacagatcatccaatgcgccagtattctcatcggacggattattcatgtcactcatttgggctgttcctcattcagcgaattcaaaattgggttgatcaaatgttctacgcgtagcgcatactgtccgtttacggtgccatattggctggtgagtaccggaacgccgtccacatgagcaataatgcggtcgggtttttcaatcggcagtacatcgccgggtttcagcttcaaaatctgggaaagacgtaacggaatatcggcaaaattggccaccagctccagttcagagtgctgaacctggcgcaccaggttatcacgccagttctgatcttcatggcgcgagttttccagcggcggattcaccagcagctcacgcagcggctcgatcatgctaaatggcagacagatgttaaattcaccggtcagattgccgatctccacatgaaacggcgtattgacgacgatatcgttcggcgaggtggtgatattggtaaatttcacctgcatttcggaacgcacatactccacttccagcggattaatggctttccatgcgtcgctatagccttccagcgccagtttcagcatacggttgatgacccgctgttccgtatgggtaaactcgcggccctcgactttggtcggaaaacgaccgtcgccgccgaacaggttatcgacggtaataaacaccagactcggcgagaacaccaccagcccggtgccgcgtagcggcttcaggtggatcaggttcaggttggtcggtactggcaggttacgcgcaaattcgtgatacggctgaatacgtatggcgcccacggtaatatccgggctgcggcgcagcaggttaaataatcccatccggaactggcgtgcgaaacgctcgttaataatctccagcgcctgcaagcgttcacgcacgacgcgacgctgggtattgggatcgtaagggcgaatatcgctatcgcttgcgataccgggagtgggttcgtctttggtgtcgctgtcgccgttcaacagcgcatcgatttcagcctgagaaagaatactatcgcccatatcgttaccgcagaataaaagctgtataaagcacgtcagtgacgacctgttttggttgtccggcaacgagcggcgcggccagcgtctctttaatggcggcaatcagtttttgtttgccagcttctgttgagagctcggcggcattctgacgggaaaataacaacagcagacggctgcgcacttccggcagatattcatttaatcgtgcgcgcgtcgcttcgtctttcagacgcagggtcacgccgatatacaacacgcgatccgcatcgcccagattgacggtaaacgtatccagcacaaaaaataccggcgcgggcggcggagccggttccgctttagcgttcgtggtcggttgctgctgcatacgccagtagctataaccggcagtcgcgcaggcggcgagggtaatcaacaccagcaaaggtatccaaatcgagcgtttgctctttttgttaatcgcggagtcagtcatctgatacgggcttcctgtttcggtactgcttattggctgattatcccgtgtcctgtccacgacaaagcgtggaaaagacgcggataatcatgctacctctggcgttaggcgaagatatccactgcgccattgccgcgcgcggcggcctgaagcgaggccggcgccgctaacgctatatcatcttcagcgccaaacgcgtctgtgtgttgggcgcgggcagactgttgttgcgatgaagactgctgctgtccggcaaagctttcgctactgatactactttgtcccaactgaatgccgctttccgccaactgggtgcgtaacatgggcagggcggcttccagcgcggcgcggacatggctgtgcggcgataccatctggagctgcgcctgattgtcatccagcttgagcgaaatgtgcacctgacctaactcttccggatgcaatcgaagctgcgcgctttgctgtccctgacgcgtaaataacatgacctgctgactgaacgtttgttgccattcatggctgcctaacggcgcgctgagtaccggggctgaggcgacaggtagcggttgcggttgcgccgtggcgctgctgagcgtcggcattgccgcgccatgcgttactggcgcggacgggctatccacctccacctccactttcgcgctggtcgcggcggcagcgaccaccagcggcgtcagtgatggccccatggcgcgatcgtcgctggcgcgcgcaagcgacgcctcggttttccctttttcatgctcgctaaaagagagcgtatgtgtctcttcctgcggcgccgatagcatgtcgccgcgtaacagtgacggcaaggcgatgtgattttcagccggcgtttctccggcgacaggcgtcgcgacaggttgtccgggcagcatggcgaataaggcgctcagactggcaagatcctcatcgctcagcgcgggcgttttctcatcatgctgcgccgttttactcaatgcggccagagcgctggttttcaacgatggcgttagcgtagacagtagatgctgcgcttgtgtcagattggtaagcgtttcatccgtcgcattcgctttttgcgccagcaggtcggcaagcttcaccgcctggcccggctcgccatgttgggccagtagctctttcgataacttgccgcctgccgcctgtaaatcggccagcgtgatgcgggcgtctttgccctgtgcgccgtctgcgcctaacgcgcccgccaggagcgccagaaagtcctcggctgaaccggtggtttttcctgacgtcagacccgcggtcatgtcggtatcggtggtgatcagttggggcagggtgatcattcgggtttcctcattgctgcacgctgagcaaattcatccatctttttctgatccatgcggttttcagctaacagcgctgccgcggtttgtcggtcctgtaaggtttgccaggcctgaagtcgctgctttttctcacgccagctcttcagcgccaggtcgactttttgcgtccactgcgtaagctggaggcgatgctgctctatcgccttttccagtgtctgaataaactgctgatagttgatccagcgattactggcgatgccgttgcccatatcggtgttcaaattactgcgatactcattctgataatcgatcagcattttgagctgttcttccgcctgttggcagccgcgacgcatttcgcccagtaaacgcgccgcgtcatctacctctttttcggccagatctttgagtgtttccagagcgccatgttgtgccatgatcgtcgccctcctgatttatcacaccgtcgggaaaattaaatcgagcgcctgaagagagtcctcccagtcggcccgttcaaaaatgccttgctgtaaaaacgcttctaattgcggccataaggtaatggctttatcgagcatcggatcgctgcctttggcataggcgccgacgctgatcagatcgcggttacgctggaaactggaaagcaattgtttaaatagccgtacccgcgcatagtgctgctcggtaatgagcgcggtcatcgcccggctgattgacgcctcgatatcaatggccgggtagtgcccggcttccgccaggcggcgggacaagacaatgtgcccgtcgaggattgcgcgtgccgagtcggcaatgggatcttgttggtcgtccccctcggtcaatacggtataaaacgcggtgatagagccgccgccgtggatgccattaccggcacgctcgaccagcgctggcagctttgcgaacaccgagggcggataacctttggtggctggcggttcgccgattgccagggcaatttcacgctgcgccatcgcatagcgcgtcagcgaatccataatcagcaacacatgctgtccgcgatcgcgaaagtcttcggcgatgcgggtggcataggcggcgccctgcattcgcagcagcggcgaaacatccgccggggcggcgatcaccaccgaacgcgcgcgaccgtcggggccgagaatattttcgataaaatctttaacttcgcggccacgttcgccgataagacccacgacaatcacgtccgcccgtgtgtagcgcgccatcatgccaagcagaaccgatttaccgacgccggaaccggcaaagagtcccatacgctgaccgcgccctacggttaacaacgcgttgatggcgcgtacgccggtttccagcacatgttcgattggcgttcgctgtagcgggttaaacggcggcgtgattaacgcgccggtttccagcgtatccggcgcaggcagtccgtcgagcggtttaccgccgccatccagcacccgaccaagcagggccgggccgagcggtaactgtttgccgctttgcagaccgtcgccatgcccgttacgggcgtaaacgcgggcaccgggcagaatgccttcgacctcttccagcggcattaaaaacagacgctggccgttaaaaccgacgacttccgattccacctctttggtttcagggccgtcctggcgctcaataatgcaggtggcgcccagcggaagctggagaccggtggcctccagtaccaggccagtggcgcgggttaaacgtccataacggcgcaccgccggcaataacgccatttttgcttcaaagttgtcgagcgcggtaagccagcgggtcaggcgcgtggtcatcagagcactcccggcgccgccaggcgacacaactcttgccagcgagtggcgacgctggcgtccagatcgccctcatcggcagagactttacacccgccgtgatgcaacgttggatcgccgcgcaaccgccatccgtgaagactgagcgtggcgcccagcatctcttccacccgctgtaagtcgtccggatgcacgcgcaactgcggcttgccgctaaagagcggctcttgctgcaacagttgttggatctgtttaatcagcgctgagttgtccaccgccggcgtttggccgatgacctgacgtgcggcctccagggccatttgcatcagccgtgaggcgataacgctatcgagcgcgtcaagcgtgttctgaaactcgctcactaactgctgcatacgggcatgaatcggcgcctgctgcgtctgcgcctgggcttgtccttgctccagcccttgcgctaacccttcctggtatccctgcgcgtgtcctttttgccgtccctccgccagcccggcgttataaccttgttcatgggcctgtatttttagctgcgccagctcctgctccagctgctgttcggcagtgagttcgggctccggcgtatcgtctgtcaaggtaacgttatcagcctcaaccggcacaaacgtctccggcggcggagcgagatcgtcgggggtccagacttgccacggcaattcattagacataggtatcctcgccgctgccaatcaccatttcgccggtttccgccagacgacgcacaataagcagaatcgctttctgctcgttttccacctgagacagacgaaccgggccacggttggcaaggtcgtcgcgcaggatatcggcggcgcgctgggacatattgcgcaggaacttctcgcgtaatggcggttcggcgcctttcagagcgatcagcagcgactcggaatccacttcctgcagcagacgttggatactgcgatcgtccacatccaccagattttcgaacaggaacatctcgtcgatgattttctgcgccagttcgccgtcgaattcgcgcacagcggtaataaccgcttcttcctgctgcgttttcatcaggttgataatttctgccgcggttcttacgccgcccattttgctgcgtttcaggttctgaccgtcgagcaggccattcagcacttcggtcaactccgccagcgccgccggctgtacgccgccaaatgtcgcgatacgcagcatcacatcatgacgcagtcgttcgtcaaacagtgccagaatatcggcggcctgactgcgtttgaggtggaccagaatggtggcgataatctgcgggtgttcgtcgcgaatcaggtcggcggcgctctgcggttccataaagttgagcgtttcgataccgctggtggtatcgcgcgtttccagaatatcttccagcaggctggaggcgcgttcttcgcccagcgctttaaccagtacggagcgcaggtattcgttggcgttgatattcagcgcggcgaactgctccgcttcttgctcaaactctgatagtacgtccgtcagttgtttgttggagatctgacgcacgttagccatcgccgtacttaacgcctgtacttcgcgggtggagaggtgtttaaacacctctgccgcccggtcttcgccaatggtcatcaacaaaatgacgcttttatcggtaccgctaagattactcatgatcgttactcatccactggcgaatgaccagcgccaccacgcgcggatcgttgtctgacatttcgcgaatacgctggctcatcacctcagcgcccagacgctggttagcccggcgttgctggagctgctcgtctttgctaaggcgtacttccacggcttcttcggtttcctggcgaacctgcgcctgttcctgcgccgctttcgcttcttcaacgcggcgcgtcaactgtggatgtaccgctttgcgccacagaatccaggccaccaccagcaccagtaaccagcgacctgccgcgagcaactgatcgataaaggactgctgttgccagaagggcagttcgccgccggtgttatccactgcgctaaacggtgaattcaccacgtttagcgtatcgccgcgtttatcagaaaaacccatcgcttcacgggttaaatcctcgatctgtttcatctgatcggcggtcaatggcagcggtttgccatccgccagcgttttgtaattcaccacgacagctacagagagacgctcaatatcgcccacattcattttggtgtgacgaatggtgcggtccacttcgtagttactggtttcattacgctgcgtattgcgcgggccagcgttgttactgttggtactggtgctggtttgtggcgtattctgcgcgttttgttgattggtcggcggtgtggcgatcggcgcctcgttaggcggcgctggttggttcgacagcgcgccaggcacgccgccgggatagcccgcgcctacctgttcgctaatattcaactgacgtgaacgcagagtggccttcgacgcatcgccgttcgggctgtagtgctcttccgtctgttctttattggcaaaatccaactgggcggttacctgagcgtgaacattaccgttcccgacgataggcgacagaatggcttcgatacggcgttggatgcggctttccacatcattagcaaattttaattgcgcgtcattaaggtcgcgaccgctggtattggattgcgtgagcagatgaccggattgatcgaccagagtgacgtttcctggcggcaaaccggcgacagcgctggaaaccagatgtaccacggcgctaatttgtccttcatccagcgcccggcccggttccagtgtgacggtgacggaggcggaaggggatttttgttcccgcacaaatagcgacggctttggcatcgccaggtgaacgcgggcgctttttaccggacccagcgtctcgatcgtccgggccagttcaccttccagcgcgcgctgataattcacctgctcgctgaactgactgataccgaatttttcctgatcaagcagttcaaagcctaccgcgccgcctttaggcagcccctgctgcgccagacgcagacgcagttcatgcactttgtcggcgggcacttcaatcgcgccgctgccattggcaaagcgataggggatattcatctgggtcaactgcgcgacgatcgcgccgccgtcctgatcggaaaggttgctaaatagcgtgcggtaatcgggcgttttggcccacagcaccatcgcaacgacgatcgccacggcggcggaacccgccacaattaacggaattcggggattcgcgcgtaggcgattaagccactcgagaggtttaggttgggttgcagtcgatgcagtcgcactcatctcgcacctcgtgactgatcgtggacggcgttttttgcaaagtggaacaagactcactcccgggtcagcaaactcgaaaaattgacggtctcattatttgtggtttcgaatttttctatgcgctaaaaaccgaggttttttatcgttatttaacgcctttatcttattgacaaactggtaatctctgctgcgtaaaaaatcatccaggggaataacatggcagcaatacaggggattgaagggggtattagccagttacaggcgacggcgatggccgcaaacgggcaagaaacacactcgcagtcgacggtgagttttgccggccagctacatgctgcgctggatcgtattagcgacagacaaacggcggcgcgcgttcaggcggaaaaattcactctgggtgagccgggcattgcgcttaatgacgtgatggctgatatgcaaaaagcgtccgtctctatgcaaatggggattcaggtgcgcaataagctggtcgccgcgtatcaggaagtcatgtccatgcaggtttaagccagggctgacaacacatccgcagcgaactcccgggcgcttacctaagtcagtggcgggggacgcgacgcccatgcaaccagtgcgtgattatgtgggcttgtttttgcgaggcgcgctcattttattgataagcgggttgcacattgttgcagggacttattaaaaatagggtacgcctgtttactgacgccattcattcctactattagttctgaggctattgtcattgagtttgcaatccagaatgttcctgcaatatatgcgccgttgcgataatacacggtaaattctttactaatacctggaatatctgtttcatggagatccagtatatacccatacggggacagattatcagcgagacagcgggcaatggcgctcggatgtgcattgactactgtgacgggtgagtaacgggcagcggcaagacagacgactccaataatggagatgaaaataatttttatcatttttttggcttctgctgtgcataaataaatcatcacctgataatgtcagtgagtaaaaatataaatacctgatagtcttttatgacgtagagggaaaataataattattttatgttttgcttaaaatagtcatggttttttcatcggctcagacaaaattaaaacggtatacgttatataatagatttatgccacggcgcacaagacgaccttgtctgatttcttttatgcgttttagatttttgccggttatgccgtaaaaggtctcccgccgtaacgtacagcgggagtatgcgcttatttttgaatcagataacgaattgtcgggccatcctgctgaatatccagcaccgtataaccgtgattgcgcgcatccagtggaatattattaatggactgcggacagtcgctgaccacttccaggatctcacctttttttagctgcggcatcgcttccagagtggcgaccgccgggtacgggcaaggttcgccaaccatatccagacggtaatcagggacgatatttttcatacagattccttagcaggcgtcagccccgcacggcggaaaaaacgtttttcccagccgatgattaacatcagcgcggtaaataacaacagataggtgaccagcagaccccccagcggaccaaaggtattcagcaggttaactttatcccaactggtcgccagcgcgggcgcgaaatcatcccagtagtaagccaggatggtcgaaccgatgacattgccgaggcccacccaccagtaatgcacctggacttctacggcgcggtacatccagccggtttcgcagccgcccgccagcacgatgccaaaaccgaacagcagtccgccaatgaccgcattcgggccagcccacataattttaggtgcaacgcccaactgcacgtagctgaaaataccaatggcgctgaccgccatgccaaaaataatcgctttcgccatatgggcgcgtccggagatccacagatcgcgaaaggccgaggtaaagcagatttgcgcgcgctcgatcagcagcccaaacccgacgccgaacagcatcgccagccccagtttcggctgatgcattgccgttaataacgcccagccaatcatgccgataaagaccagcataccgagcctgaaacgccgtcttgcctgatccggtttctgcgtcagtggcgaagccgcggagaccttttgcattttcaccggtatgcgaaatatcggcagcaacgtaaagcgggcgccgaaccaggaaccgatagcggtcgccagcgcaaagaaccacgcgtgtagggagaactgcgggatcccggtaaaaaaggcggccaggttacaccccatcgccagacgcgcgccgaagccagcgatcatgcctccgaccaccgcctgtacgatacggattcggctgcgcggcatacgcagttttacgttgttggcccacagcgccgcggcgaaacagccgccgaacatgccgaggatcatcatgccgtcgatacgcgtcagcggcgtaccttccagatgaatcagcttgtagtagccccactgttcggcatgaacgccaaaaagctgcaaaatttgcccgccccagcgggtaaattcgcccgtcacggcccaaaacgtgccggtgatgccaaaatagtaggtagagagaataccggctgcgatcaccgcaggggccggcgcccagaatttaattaaccaggtttgcttgaagtgttgccatgacatgtgtttagcctctgaactcagaaggtgtgaaacaagaagtgcgcatactacaccgatcacagaatttgcctacacctaataagcggtaataccgactggatcaaattgcggccagcgcctggaaaggctggcggcgtcagggctttaatgccacaattcttctttcttctttcttctttcttctttcttctttcttctttcttctttcttctttcttctttcttctttcttctgatgcaggatgaatgatgaaaaaagtagcgatcgttggcgcattgctggttctggccggatgcgccgaggtggaaaactataatgatgtggtgaaaacgcccgcgccggccggtctggaagggtactggcagtcaaaaggcccgcaacgtaagctggtgagccctgaagctatcgccagcctggtggtgactaaagaaggcgatacgctggactgccgccagtggcagcgcgttattgctctgccgggcaagctgaccatgctctccgatgacttaaccaatgttacggttaagcgtgagctctatgagattgagcgcgacgggaataccctggaatatgatggcatgacgctgcaacgggtcgctcgtccgacgccggagtgcgccgccgcgttagaaaaaacgccgctgccgacgccgctgccgtaatttcgcttcccggcagcgctctgccgccgggaacgctcatcacacgtcctcaatgacccacacgctgacgctgcctgcgttgcagaagaacgtcgcttcgccttgatcattagttacaacatgctcactgcggtttcccagaaaatcacgccaggtcttgttagcgtaattgtcgccgagcaggagggttttttcaccgtcgtcgccattggaaagtacgaccacacagcctggattctcttcagtaccgctgcgactaaaggcgatacagttgggatgatcgaaaaagagtgtttgtataccgtgcgcaaaacgctgacgagcgaggatcagccgatccagttggttaatcaccggcatgtcgacccgacaggtctcgccattttcgccgttatcctcatagctggcgccgtataaatcgggataaaacaccgacggtacgccgttttcacgaagcaggatcagcgcataggccaatggtttgaaccagggttctaccggcgcttccagcgcctgtaacagttgtgtatcgtggttagcgaccagcgtcaccgcatgaaaagggtcggcttctaccagcgtgccggtgaaaatgtggcgcatgtcatactccgcgccctggcgcgaggcttcatgaaatttcatctgcaacggcgcgtcgaacagcatggttttcccgtcggcctgatcgatgtacgtttgcagtttatccacttcatgcgaccagtattctgcgacaataaacagcggttttggcgcaaccgcctgtacatgctcaatccattctttataaaaccaggcgggtatatgttttaccgcgtccaggcgaaagccgtcacaatgggtttgttccatgacccaacgagcccaatatttaatctcttccgtaaccgcgtgattgcgaaaatcgatattttcccccatcagatagtcgaaattacccagctcatcatcaacctgatcgttccagccatcgccggtatagtcattgacgatcttaaaaatgccgtcttcgtcgggattctcgatgtgatcaatgccgctgaaacagtgatagtcccaaataaagttggaatactggcccgcgcgggcagggaaggtgtagcgcgtccagccttcgcattcaatgatgttgtcatcaatttgcgtgcggtcatcctgattcacgcgctgaacgcgaatacgttctttttcgtctgcgcccattttgtggttcacgacgacgtcgagcagcaccgcaatattattttttttgagcgcgtctatcgccgtcagtaactggcgtttatcgccgtactttgtcgcgatagttcctttttggtcaaattcgccgaggtcaaacaggtcgtagctatcatagcctacggaatagccgccggaggcgcctttacaggcgggcggtagccagaccatattgataccgatatcattcagcccatcagcacgttccgccagctcagaccagagttttcctccgtcgggataataccagtggaagtactgcaataacgtggggtttttcatcttccgtgctccagaagtcgtttagccgacctctggagtatggaagaattttcatacgagacgggaaaatattatgaggcgccaggtgcgtctggcacgagtaacataccggaaagacggccataagcgttgttgagtgatttttggcgggtggattgtccgatcaaactactcagttcatccagtcgctgttgcagcagccctttcaggagctgctcattatccagcgtttgtttgatgtatccggcgaccatatcctgaatacttcgcgtaatgcccggtggagtttgcttttccatcaccgtttcaatactttgcagataggagacctcttgttgcagtaagagatcccattcacctcgctgcgcaagttcaagcagcgattgactgagcagcgcaatacgctgccaacggttgataaactccacggttgaggtcattaacgagactcctggaaagatgctttcggtgaaatctgcttccaggcttctgcaatattgctgagtaacctttccacttcttcgatggcctgagcgtcgttacgcaaattagcctgcagtaaacggcgaatcatatagtcgtatagctcggaaagattcgtcgcaatctcaccgcctttttcctgatcgaggccggctttcagcccgttatcgataatattgatggctttgcttaacgcttcacctttcgcgacaacatcgccttgttctaaaaacaggcgagcgcgcaccagagcgctattcgcgccatcaaacaacatttcaatcaactgatgcgggctggcgctcatcacggcgctttccacgctgacttgcgcataagctttgataccgctcgcggtgtacatggtgacctctgttatcaggacttgttcatagctgtaaattgctgggtcaaataactactggtgttattcagcttactcatcatggtatccagttgggtaaactgggccttgtaacgggcaacggtttcatcgatgctgttgctaacggacaggtactgttttgtcaggcttttcagcgtggcgttaacgttgtcctgcgcattatcaataatgccgtcatccgccagataacttttcacttcggtggcaattttggtggtgatacccgtttctttaccatcgcctaccagcagctcacgcgctgcggccgtgttatctttcagtaccttggtcagcttatcatcgtcaatcttcagtttgccggaagtcccatcctgggtgatgccaatttccgccattgttttgaacgcagaattactgccgctattggcaaattgtgcccgaatcccggtctggatagcacgaaccacactatcgcctaacagcgcgccgtttttatcgctggcttcttcgcccggctcaacggcggtatatttagttaatgagctaaaagtatccaccagcgagttataggcatccacccaggatttaatcgcctctttcgccttggtatcatctttcgtcaccgtcacggtcgcgtcggtcactttcttggtcagggtgagtgtaattccctgaggggcgtcggttacggtattgctctgacgctcaatgtcgatgccgtttacgttcagcttcgcgttttctgctttcaccagctcttgcatattgccggtattggtggtgctgtcataagcgagtagatcgttaagttttgtatcgccttccaccgtgatcttcatcgtattgtcggtaccgctattggcggtaagcaccaactggaattcgttctctttgaccttaacgatactggcggcgataccgctgtcggcgtcattaatggcgtcacggatcgcctccatggaggtgtcgcctttatccagcttaatttccagcggctctttacgtcccggctgttcaattttaattgtccgggatgtgaccgacgtatcgcccaactgctctttggtggttgcgaaggtggtttttgtcgccagcgactgcgcggcggcaagctgggttacgctaatcttataagtccctgcggcagcgcctgcggtagtactgactttgaggtcctctgtcgtgctggacgccacggtagacttaaataaatccgctttatttaacgcggtatttgccgtctggaatttttctaatgcgcttttcaatgtgccataggcggttagctttgccgaattcgcgctctgctgtttggtaattggcgttaagcgtcctttttcgttctttgtcaggtctgtcaacaactggtctaacggtaagtttgatcccacacctaatgatgaaattgaagccatgccttcttcctttttgattgcaaacagtagttaagcgcgttatcggcaatctggaggcaaagtttaatgataattttgcaaaaataatgcgcggaataatgatgcataaagcggctatttcgccgcctaagaaaaagatcgggggaagtgaaaaattttctaaagttcgaaattcaggtgccgatacaagggttacggtgagaaaccgtgggcaacagcccaataacatcaagttgtaattgataaggaaaagatcatggcacaagtcattaatacaaacagcctgtcgctgttgacccagaataacctgaacaaatcccagtccgcactgggcactgctatcgagcgtttgtcttccggtctgcgtatcaacagcgcgaaagacgatgcggcaggacaggcgattgctaaccgttttaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgcgaatggtactaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggtgccaacgacggtgaaactatcgatattgatttaaaagaaatcagctctaaaacactgggacttgataagcttaatgtccaagatgcctacaccccgaaagaaactgctgtaaccgttgataaaactacctataaaaatggtacagatcctattacagcccagagcaatactgatatccaaactgcaattggcggtggtgcaacgggggttactggggctgatatcaaatttaaagatggtcaatactatttagatgttaaaggcggtgcttctgctggtgtttataaagccacttatgatgaaactacaaagaaagttaatattgatacgactgataaaactccgttggcaactgcggaagctacagctattcggggaacggccactataacccacaaccaaattgctgaagtaacaaaagagggtgttgatacgaccacagttgcggctcaacttgctgcagcaggggttactggcgccgataaggacaatactagccttgtaaaactatcgtttgaggataaaaacggtaaggttattgatggtggctatgcagtgaaaatgggcgacgatttctatgccgctacatatgatgagaaaacaggtgcaattactgctaaaaccactacttatacagatggtactggcgttgctcaaactggagctgtgaaatttggtggcgcaaatggtaaatctgaagttgttactgctaccgatggtaagacttacttagcaagcgaccttgacaaacataacttcagaacaggcggtgagcttaaagaggttaatacagataagactgaaaacccactgcagaaaattgatgctgccttggcacaggttgatacacttcgttctgacctgggtgcggttcagaaccgtttcaactccgctatcaccaacctgggcaataccgtaaataacctgtcttctgcccgtagccgtatcgaagattccgactacgcaaccgaagtctccaacatgtctcgcgcgcagattctgcagcaggccggtacctccgttctggcgcaggcgaaccaggttccgcaaaacgtcctctctttactgcgttaatccggcgattgattcaccgacacgtggtacacaatcaaggcagcgaaagctgccttttttaattccggagcctgtgtaatgaaagaaatcaccgtcactgaacctgcctttgtcacccgcttttcctgttctggctcggcctgtcgcgaccattgttgtaagggctggaaaatcacgctggataagacgacggttaaaaagtatctcgccagtaaagacacgacgattcgtaccatcgcgcaagaccatattattctgctgaaaaagaacaataatcattggggggaaattaaactgccttcggcgctgggaagttgcccttatctggatgaggaccgtttgtgccgggtacaaaaacgttaggcgcaaaggcattaagtcatacctgttcctctttcccacgggcgcaccatacctataaaaatgaggtacgtaactccctgagtcttgcctgtccggaggtaacgtcccgcattttaaacgatcctgacgcaatggcgctcggcgaaaaaacaatcattcagcagacattcaatactgcgccgttattctcaccgcagcaaaagttactcaatctgttttgcctgagtctgatcaaccatgccaacagcagtacggaaacggcgctctatgggttgattaaattcgtcatgtatgcacataaatttgccaaaattgatgatgccgcgctgggtgaactggaacaggtgtatgccgcgttacttgagcagttgcagaccggcgtgctggcgcaggaattgatgaatatcgcgccggacagcaaggtaaaaacctcgctggtattgcagatgcagaactatttccgctcgctcccgcttagtcgtggcagtgttatcctcgatcactatatccagtgtcttctgcgggtgctgacggcggaagagggcgtttcaatggagcagaaggttagcgatattgagtcctcattagcgcgctgtttacaggcggatgagcagcagaagaactgggctttcagaaatttaattctctataaaatttgggaaaataatttccccaaccagccgaatgtcgacccgttacgcgcgctgtatattatcgtggcggaatatgcctttattaagctattaacggcagccagcgtgcatgagcgcgggcggcttgagtgggatgacgttaccaatattgtgtatagctttcactcccgcagccagcataacagcgaggtggcggcgaattttcatcgccatatagaaacggtgcgtactggcgacgatctgtcgatgattcatcttctgacatagttttgttcggggtgggcttttgcgcatcccgtttatcctatctggctgattttattctgctctttgaaccgctaaaaaggcgctacaggttacataagtgaaataacccttcttttatagccttattccttcgatagaaccctctgtagaaacggataatcatgccgataactcatttaacgcagggctgtttatcgtgaattcactgtataccgctgaaggtgtaatggataaacactcgctgtggcagcgttatgtaccgctggtgcgtcacgaagcattgcgcctgcaggtgcgattgccggcgagcgtggaactggacgatctgctacaagcgggcggcatcgggttattaaatgcggtcgaccgatatgacgctttgcaaggaacggcatttaccacttacgcagtgcagcgtattcgtggggcgatgctggatgaattacgcagccgcgattgggtgccgcgtagcgtccggcgtaatgcccgcgaagtggcgcaggcgatgggacaactggagcaggaactggggcgtaatgcgacggaaaccgaagtggcggaacgtcttggcatccctgttgcggagtatcgtcagatgttgctcgataccaacaacagccaacttttctcttacgatgagtggcgggaagagcatggcgatagcatcgaactggtgactgaagaacatcaacaggaaaacccgttacatcaactgctggagggcgacctgcgacagcgggtaatggatgcgattgaatcgctgccggaacgcgagcaactggtgttaacgctgtattaccaggaagagctcaatctcaaagagattggcgcggtactggaagtcggcgaatcgcgggtcagccagttgcatagtcaggccatcaaacgattacgcaccaaactgggtaagttataggtagcgcatgatcgcacccgaaaagtgccgcacaacatatagactaccaggagttctcatgacggtgcagcaacctaaaaggcggcccttgagccgctatcttaaagactttaaacacagccagacgcattgcgcgcattgtcacaaattgctcgaccgcattacgctggttcgccgtggcaagatcgttaataaaatcgctatttcacagctggatatgctacttgacgacgctgcctggcagcgggagcagaaggagtgggtggcgttgtgtcgcttttgcggcgatttgcactgcaaaaagcagagtgattttttcgatattatcggtttcaagcagtatttgtttgaacaaaccgagatgagccatggcacggtgcgggaatatgtcgtgcgtttacgacgtcttggcaattacctcagcgagcaaaacatttcccacgatctgctgcaggacggttttctcgatgaaagcctggcgccatggttgccggaaaccagcaccaataattaccgtatcgcactgcgtaaataccagcaatataaagcgcatcagcagattgcgcccagacagaaatccccctttaccgccagttctgatatatattaaaaaagcataagatgtagcagagtcgtgttggtgaaacgtggcaaaccttctacattaggctgagtcccccaaaggttcgcgagacgtgacgatgcgccatggcgggacacagtctatggtcattaacggcaatattcggggttactatgaaattagcactgctgggacgtcaggcactgatgggagtaatggctgtagcgctggtggcgggaatgagcgcgaagagctttgccgatgagggtttgctgaacaaagttaaagaacgcggcacgctgctggtagggctggaaggtacctatccgccgtttagctttcagggcgacgacggcaaattaaccggttttgaagtcgatttcgccgaggcgttggcaaaacatctgggcgttaaagcgtcgttgaagccgaccaaatgggacggaatgctggcgtcgctggactctaaacgcattgatgtagtgataaaccaggtcacgatttcagacgtccgcaagaaaaaatatgatttctctacgccttatactgtctccggcgttcaggcgctggtgaaaaaaggcaatgaaggcacgatcaaaacggcggccgatctgcagggcaaaaaagtcggcgttgggctggggactaactatgaagagtggctacgtcaacatgttcagggcgtggatatccgcacctatgacgatgatcctacaaaatatcaggatctgcgcgtaggccgtattgacgcgattttagtcgatcgtctggcggcgttggatctggtgaaaaaaaccaaaggtacgctggccgtcaccggtgatgcgttttcgcgtcaggagtccggcgttgcgttacgtaaaggcaacgaagatttgctgaaggcggtagataatgccattgcggaaatgcaaaaagatggcaccttaaaagcgctctccgaaaaatggtttggcgctgacgtgacccaataatgctctacgttgcccggcaggtagtgcgccgccgggcaatatcaacctcatactatgtcagcaaacggaggcgcgtgaatcggcgccttttttatttccattagatcaacgtgcataataaaaagaacacaccacaacgttaccggaggctcaatgccactacatcacttaacgcgctttcctcgcctggagcttattggcgcgccgaccccgctcgaatacctgccgcgattgtctgattatcttggccgtgagatttacattaagcgcgatgacgttacgcccattgcaatgggcggcaataaactgcgtaagctggagtttctagtggccgacgcgctgcgagaaggggcggatacgctgataaccgcaggggcgattcagtcaaaccatgtccgtcagacggcggcggttgcggccaaattggggctgcattgcgtcgccttgctggaaaatccaatcggtaccaccgcggaaaattacctgacgaatggtaatcgcctgttactggatttatttaatacacaaattgagatgtgcgatgcgctaaccgatccggatgcgcagctgcaaacgctggcgacgcgcattgaagcgcaagggttcaggccctatgtgattccggtcggcggctccagcgcgttgggcgcaatgggatacgtagagagcgccctggagatcgtccagcagtgtgaagaggtcgtcgggctctcttcggtggtggtggcctccggcagcgccggaacgcacgccgggttagctgtcgggctggaacatctgatgccggatgtcgaactgattggcgtgaccgtttcacgttctgtcgccgagcagaaacccaaagtgattgccttgcagcaggctattgccggccagctggcgctgacggcgacggcggatattcatttatgggatgactattttgccccgggttacggcgtgccaaatgacgcggggatggaggcggtgaaactgctggcgaacctggagggggtgctgctggatccggtatataccggtaaagcgatggcgggtctgatagatggcatcagccagaaacgctttaacgatgacgggccgattctctttattcataccggtggggcgcctgcgctgtttgcctaccatcctcatgtataacctccaggtaatcaacgcgaatgcaagaaagtatccaactggttattgaatcgctgccgtatttgcttaaaggcgccgtctttaccctgcaactgagtattggcggtatgttttttggtctgctgctgggatttgtgctggcgctgatgcggatgtctccgctatggccggttcgctggctggcgcgcttttatatctcgatttttcgcggtacgccgcttatcgcccagttatttatgatctattacggcctgccgcaatttggtattgagctggaccctatcccggcggcgatgattggtttatcgctcaataccgcggcttacacgtccgagacgctgcgcgcggcgatctcggctatcgacaagggacaatgggaagcggcggcgagcattggcatgacgccgtggcaaacgctacgccgcgctattttgccgcaggcggcccgcgtcgcgcttccgccgttgagcaacagctttatcagcctggtgaaagatacatcgctcgccgcgacgattcaggtgccggagttgttccgccaggcgcagttaattacctcgcgaacgctggaggtgtttaccatgtatctggccgcgtcgttaatctactgggtaatggcgaccgtcttatcggcactgcaaaactatttcgaaaaccagcttaaccgccaggagagagagccaaaatgagtgctatcgaagtcaccaacctggtcaaaaaatttcatggtcaaacggtgctgcacggtatcgaccttgaggtgaagcccggagaagtcgtcgccattatcggcccgagcggctcagggaagacaacgttattacgctgtattaacctgctggaacaaccggaagcgggcaccattaaagtaggcgatattatcatcgataccgcccgcccattcagccagcaaaaagggttgattcgccagctacgtcagcatgtcggctttgtctttcagagttttaacctgttcccgcatcgtaccgtgctggaaaatatcattgaaggtccggtgattgtaaagggagagccgaaagctgaggcgacggcgctggcgcgggaactgttagccaaagtcgggttggccggtaaagagacccgttatccgcgccgcctgtcgggcgggcaacagcagcgcgtggcgattgcgcgcgcgctggcgatgcgcccggaagtgattctgtttgatgagccgacgtctgcgcttgatcctgaattagtcggcgaggtgcttaatacgattcgccagctggcgcaggaaaagcgcacgatggtgatcgtcactcacgaaatgggctttgcgcgtgacgtggctgaccgggcaatatttatggatcaggggcaaatcgtcgaacaggggccggcgaaaaccttgttcgccgatcctcagcatccgcgtactcgccagttccttgagaaatttttagtgaaataataccttttcaacgctcgcccgaattagccgtgcctcgggcgagcgcaatgaataattatgaagtcattctgccagattattaacctcgctctttggcggaagtcgaaaaactgtaatgccgctcaagtattctatgattcgtccgatattccttatatataaacaccatttatgtgttaatttaagtcattcataataatgattatcaatatcaaaggcgtgaccataaaatatgcaggaaaatgatttcttcacctggcgacgcgcaatgttgttacgctttcaggagatggcggcagcagaggatgtttatactgaattgcaatatcagacacagcggctggaatttgattattatgccctgtgtgttcgtcatcccgttccctttacccggcctaaaatatcgcttcgtaccacttatcctcaggcgtgggtaacgcattatcagtccgaaaactatttcgcgattgatccggtattaaagccggaaaatttcaggcagggtcatttacattgggatgacgtgctatttcatgaagcgcaggcgatgtgggatgccgcccagcgtttcggattacgcagaggcgtaacccagtgtgtgatgttgccgaaccgggcgctgggctttttatctttctcccgtagcagtttacgctgctcctcgtttacctacgatgaagtggagctgaggttgcaactgctggcgcgggagagtctttcggcgctgacaagacttgaagacgacatggtgatggcgcctgagatgcgtttcagtaaacgtgagaaagagattctgaagtggacggcggaagggaagacctcatcggagatcgccattattctgtcgatttctgaaaataccgttaacttccatcagaaaaacatgcagaagaaattcaatgcgccaaataaaacacagattgcctgctacgctgcggcgacaggtctgatatgacgtgctgacgatgcttcgcgccagacgcgaaaccggctgaaagcgatgctaacagccggttttttactactggcggtaagcctgtttaatttgcttaaccgtactggaaaataccgccgcttgtgcttcatcatccatctgcgcgatctgtttttccattttaagaatcacgcgccctgcatcggcctggcccatcgcctgcagcatcagcgttaacatggctttcaggcagttgacttcagtagccagttcttgattattctcagcggtggaaaaatcaggcgtactcatttattttcctcgttatgtttcagtgaaaatgtgcgatagcagatgttaaggcggcggagtataccataagctacgctaaaaatagcagtggttgttttttgatcaaaaagcagaggggttacccacaaaataaacgttgccgcgtgatgcatatattttcttcattctttgtttattacgcgtattttactcgttaattattgttacaaagttgattccctaattagtgtttagacagcggaacgtgaaatttttgtcaccattatgaaatagcagcccggaacagcgccgtcagaaggggctacaacgttggcagttgccacatgacgtacaacataatttccaaaaacgagagcaaaatcgaatacccggtgtttttttacgtttcaaagttgagataaaaccagctaatataagggcgattaactatcagtagcgttatccctattctggagatattcctttgatcaacgttcttcttgttgatgaccacgaactggtgcgcgcagggatacgacgcattcttgaagatataaagggcattaaagttgtcggtgaagcgtgctgcggagaggatgcggtaaaatggtgccgtactaacgccgttgacgtcgtgctgatggatatgaacatgcccggtattggcggccttgaggcgacgcgtaaaattgcccgatcgacagcggatatcaaagtgatcatgctgaccgtccatacggagaacccgttgcccgccaaagtgatgcaggctggcgcagctggctatctcagcaaaggcgctgcgcctcaggaggtggtgagcgctattcgttcggtgtattccggacaacgttatatcgcctccgatatcgctcaacagatggcgctcagtcagattgagcctgcaaaaacggaaacgccgttcgccagtttgtctgaacgcgagttgcagattatgctgatgatcaccaagggccagaaggtcaatgagatttcagaacagctgaatctcagtcctaaaacggtgaacagctatcgctatcgtatgttcagtaaattaaacattcatggtgatgttgagctgactcacctggcaatccgccatggcctgtgtaatgcggagacgttaacaagccagtgagtgaaatatttgacgcaaaggcgttcctgaaaaccgttaccagccaacccggtgtctatcgtatgtatgacgccggcggtacggttatctatgttggtaaagcaaaagacctgaaaaagcgtctttccagctactttcgcagcaacctggcttcgcgtaaaaccgaagcgctagttgcgcaaattcaacacattgatgtcacggtaacgcataccgaaacggaagcgctgctgcttgagcataattacatcaagttgtatcaaccgcgttacaacgtgttgttgcgtgatgataaatcctatccttttatttttctgagcggcgatacccatccgcgtctggcgatgcaccgtggcgccaaacatgcgaaaggcgagtacttcggtccatttcctaatggctatgccgttagggaaacgctggcgctgttacagaaaattttccctatccgccagtgcgaaaacagcgtgtatcgcaaccgctcgcgtccttgcctgcaataccagattggccgctgcttaggcccctgcgttgcaggactggtcagcgaggaggagtacacgcaacaggtggagtatgtccggttgtttttgtccggcaaggacgaccaggtcttaacacagctgattgcccggatggaaaaggccagccaggatttggcatttgaagaggcggcgcgtattcgcgatcagatccaggcggtacgccgggtcacggagaaacagtttgtctccaatgcgggcgacgatctcgacgttatcggtgtggcttttgatgcgggtatggcctgtgtgcatgtgttgtttattcgccagggtaaggtactgggcagccgcagctattttccaaaagtgcctggcggtacggaactgggcgaagtggtggaaacctttgtcgggcagttttacctgcagggtagccagatgcgcacgctaccgggcgagatactactcgattttaatctgagcgataaaacgctgctggccgattcgttgtcggagcttgccggacggcgtattcatgtccagacaaaaccgcgcggcgatcgcgcccgctatctcaagctagcgcggaccaacgcggcaacggccttagtcactaaactttcgcagcagtccaccatcacgcagcgtttgaccgcgctggcgacggtattaaaacttcctgcgatcaagcggatggaatgttttgacatcagccataccatgggggagcaaacggtcgcatcctgtgtggtatttgacgctaacgggccgttacgcgccgagtatcgtcgttataatatcgcgggcatcacgccgggtgatgactacgcggcgatgaatcaggtgctacgtcggcgttatggcaaggccatagaagaaagtaagattccggatgttattctgatcgacggcggaaaagggcagctcgcccaggcgaaagccgttttcgctgagctggatgtcccctgggataagcatcgtcctttgctgctcggcgtcgccaaaggcgcggacagaaaagccggtctggaaacactcttttttgaaccggaaggcgaggggtttagcctgccgccggactcgccggcgctgcatgttattcagcatattcgcgatgagtcgcacgatcacgcgatcggcgggcaccgtaaaaaacgcgcgaaggttaaaaataccagtacgctggaaactattgaaggcgttgggcctaaacgtcgccagatgctgctgaaatatatgggcggtttgcaaggattacgtaacgccagcgtagaagaaattgcaaaagtgccgggtatttcgcaaggtctggcagaaaagatcttctggtcgttgaaacattgaggccactgtagcaacataggggtaatttcactgacaacagatagttacccgtcactatgcaatttaatatccctacgttgctcacgctgtttcgcgtcatcctgattccattctttgtcgtggtgttttatttgccgttcgcctgggcgccgatggtcagcgcgctgattttctgtattgccgcgattaccgactggtttgacggctttctggcgcgacgctggaaccagagtacgcgtttcggcgctttcctcgaccccgtcgccgacaaggtgctggtggcgatcgccatggtgctggtcaccgagcattatcatagctggtgggtgacgttacctgcggcgacgatgatcgcccgcgaaattattatctctgctctgcgtgaatggatggcggagctgggcaaacgcagtagtgtagcggtctcctggatcggtaaagtcaaaactaccgcgcagatggtggcgctggcgtggctcttgtggcgtccgaatatctgggtagagtatgccgggatcgcgcttttctttgtcgcagcggtgctaacattgtggtccatgttgcaatatttgagcgctgcacgcggagatttgcttgatcagtgatcgtttcgccgcaaatttcagcaaacgatcgtgagtgacgaaaaatatcgttgactcagtgcgtcaggtaagtagaatgcaacgcatcggacggcagcactgattgccagacgataacaaaatcaagcgattaacaaagttgcttgatactgcgggaatagctcagttggtagagcacgaccttgccaaggtcggggtcgcgagttcgagtctcgtttcccgctccagtttaaaagcattggcgtaaagcggatgctggctgaaaagccaaaaaaatttggcgcgttaacaaagcggttatgtagcggattgcaaatccgtctagtccggttcgactccggaacgcgcctccaatttttcccgagcccggatggtggaatcggtagacacaagggatttaaaatccctcggcgttcgcgctgtgcgggttcaagtcccgctccgggtaccatgggaaagacaagaataatcaaagcaataagcagtgtcgtgaaaccacctacgggtggtttttttgtgctttcagtttgtatgccgaccgcgagcgtgaactctccagcgcgatacacagtaaaaaacatcggtagcggcatttctgccagtacaacagttatgtgctaccgacccgcaagaacttatgcctggtaaatactaaacgtcgggtaaatcagccgataaaatccattaatctctataaaaaatgctgatatgttttatgcctgctttattaaagagagtaggtctgccagtgaaatataccgataatgcaaaattatttattagcttcattaatattgggattgtaagttgcgctttgctacttttttattttgtatgagcctgagagtgcaatcgtaacctactctcttcccggtgagctttcctcttcgacatgtgatgcacataattttattggctacgtcgatgcaaatgactttgcagagtatataaaaaaagtagaactgacgcgctacaatatgtattgtctgaaaaaaacaggggcaggccagtggagtatttatgcaaattaaacgagtatataactgttcaggggtattttctgcacaatttaattaaaggtagatagcgaactaatattcatcactaggtaatgtgatccgcttcatgctttaatcacgttttgcaatattgtcttaataacaggtcaactacagataatttcgggttttcgtgaatggcggttttggtcagtctctatattatgctttccccgctttacggagatgatgatgcaaaagaaaacctgggccgttttattgataccattgtgcctcaccgcttgccaccagacgaccaaccgatcaacagccaaagatgaaattctcacagggagctatattgacccgacaaaaacacgctttccgttagcggattattcacagtcggttgataaatggatacctccggactcggctgattacactattccggttattgatagtgctacccaacaacgctactttagcgcactaaaatctcattatttcggaatggacagtgaagcgcactcgccgtggaatgatttttatattaccgcattgctgaaaaaaaacgcagcacaggcccgggatgccagtattaagcagtttcttagcgacggcagtgcttattggggggaaaacttcagactttatacctctcgctggaaagaggaggttagagggaatacggatacgcagattgacaatatctatcatgcctcccggcgaggcattatggtcagagaaagtttagtcagagcgctgccaacggacgacccgctctttaacgatccccgtcaggcgggcgaggggtacccgtttgataatttacaaatgtcttcgctgcgtcccggtacgccggtctatacgctgacgaagagcaaagaccaacgctggcaatatgtcgtttcaccagcggtaactggctgggttcacagtgaagatattgccagtacggatcagaaatttataacacagtgggttttgctcgctcacaagcaactgggggcatttatcaacgcgccggtttctgtccatgccgcaggcgtctattatttcaccgggcgaccgggtactattttaccgttccgacatcaacgggcgggccagttcctgattgcggcgccagttcgcggcagcaacggtcgcgcgtttatccattgggtctggctaagcggtaacgagtttacggctatgccgtggaaaatgacgccggaaaatatcgccgtgctaatgaaagcaatgcacggcgccccctacggttggggaaattttaacttttataatgattgttcagccgaagtccgcagcctgttaatgccgtttggcatattcctgcccagacattcatccgcgcaggtagagtctgctggacgggtggtcgatcttagtcataaaaatccccaaatgcggatcgattatctcaccagatacggaaaagcgtttactacgctggtctatattccagggcatattatgctgtatatcggtaacacaaccatgaatgggcaggtcgtgccgatgacttatcagaatatctggggattgcgcccaaaccatgctaatagccggagcattatcggtgaggcggtatttttgccgttactgcgtttttatcctgaaaatcctgagctgatatcgctggctggtaaggttctgtttaagcttggttatatagaataggttgacaaactgtgttatcgcggaagacatgattaaggcaaccgtgcgcgtggatataaagatagtatccctgtaaactgtgtctgaaaaaagtatacgctatagtgcgggctgtttatttgaaatactatctggagctgattctggatgtgattatgtgcctcacacattgaagtgagagttattgttggcggtatctggctggaggctgggtggtaaaaagacgtaatttattgcattttaataacggtgcccggtcagagcgcgatcttggggatctggtcactaaagtttttgagaaagcggcgaaaaaagaaccgcaaccgctatacacatttagcctgccgttgctgagtgtgcaagatgagatccgtgtttactgtaagaaaaaaatatcaaaatagggtacgatacgctgtttatggaaataaccttttctgctgacagagaagcggtagacgaactcattaaacacttttttactgaaaataagctctatttgagagggcggttttatctgtccgcggcggtggtataagttagcatgagtataatatagcgagaaacctatctctcacttttgtgtggggcgagcgcttcctggcggaaaatctgcgccctgatcctccttttgtgcgttaacttccggaatcctcctcatttcgtgttaatctggcccctgatggttgccatccaaactgcctgcaaaaaaattatttttatccgctgcaatgtaagaggcctacaggcggaagtcatcactgaggaaaagcattatgaaaatggaaccattaaacgagaacgagctggaatggctggatgatgtgctgacgaaatacaataccgatcaggtcattttggatgtcgcggagctggacggtctgattactgcggtactaagttctccgcgtcccatcgagccggaacagtggctggtcgcgatatgggggggacccgcgtacgtaccgcgctggacatctgaaaaagaaatgacgcgatttatggatctggtattccagcacatggcggacacagccgcccggcttgaagactatccagaacagttcgagccgctgtttggcctgcgagaagttgatggccatgaattaacgattgttgaagaatggtgctttggttacatgcgcggagtgtcgctgtccgactggtctgacttgccggatacgctaaaaccggcgctggaagcgattgccttacacggcacggaagaaaactttgcgctgttggataaaatgagcccggaagcgttcgataaaagcgttgacgctatccgtatcgcggcgcttgagctgcatgcctggtggatggcgcatccgcacacgacgccgctacagatgccgataaaagcggaggtgaaagtggggcgtaacgatccttgtccatgcgggagcggcaaaaaatttaagcagtgctgcctgcattaatggctcgtaaacggccatagcgtgatgattatcgagcctggacggcgtccgggcccggtaatctttgcctggcgttaacctggatcgggcaggaaccccagtgcgatcgaaaactggacgccaatcacgacaatgccgcagataaacaccagcgccagcgctggcgtgccgcctgccacacgatatcccgcctgagggctctgtttacggcattgccagaccagcatggcagggatgagtagtgccagcactgccagcgctacgccggcatagcctaatgccatcacaaatccacgtgggtagaaaagcgcaaacgccagcggcggcagaaaggtaatcagcccggtttgcaggcgtccggacaccgtactgcggcgctggaatagatcggccaggtaatcaaataatcctagcgctacgcccagaaaagaggtcgccagcgccagatcggcgaacaggtggaccgccagttcgacatgtggcgaagcgaccacttctctgagcgcctgcagcaggccatttaacccggcatggctggccagtagccctctgaatgtcggcgagtcgatacttcccagcgtggcgagctgccaaaaaatataggccactagcggaatggcgctacccgtcataaagacccaacgcagccggcgaatgttgccgttcatataactcacaatactcggtacgcttccgtgaaaaccaaacgaggtgaaaatgaccggtatggcggacaatgccagcccctgctgtaaaggaagcgtaagaagatttactttatgaatatgtggcgtgagcaacgcaagcatgatgaccagaaaaatgatcttcgcgctaaacaggaagcggttaaaaaggtcgaccagcgaggtgcccacacacaccaccccaccggcaacaaaggtgaacagcagcaccccggcagcgggcgagagcgtggcgccaagccagttattaatactggatgccagtaattctccggctccggaaatgtaggcggcggtgagcgcatacattaagaacatcatgctgaatcccgtaagccactgtccgtaacgtccaagatagcgttttgccaacgagcccagcccggtatccgccggaacatgttgatatacttccagtaatagtagcgcggtataacacatcagcgcccacagaccaatcaacaatcccagcgtgacgctgaaaccaacgccagccgctgccagcggcattgccagcatcccggcgccgatagtggtgcctgccacgataaaaatactgcccagagttctgtttttcacgctttctactaccccggtaacaaagaacggtgatatccgcggcgcagggtaaggcattacgctattttcgtcaaatggtcgttacaataggtgtactggaaattttacagttccgggcataaaagcgaatatgggaggagacgcggacaaccgccgcaaacctgcgctagcgcaaagtcgctcgcacaaggacacattaggctacaagttttattcaggagggcttatggattccattcacggtcacgaagtactcaacatgatgattgagtctggcgagcagtacacgcatacctcgctggaggcggcaataaaagcgcgctttggcgagcgggcacgatttcacacctgttcagcatcagatatgacggcggcggaactggtcgcgtttctggcggcgaaaggaaagtttattgcggtggaggacggtttttcaacgcatgagagtaaaatctgccgccattaatacgccacggtgagagcgcgtctcaccgtgtaaggacgtgctggattaattttgcgtatccagggtggagagttctttatcaatgaaataaagcccttcgccgctttttcccgccagcgttaatttatcaataatagatttgaacagtttttcttcttcatgctgttccgccacataccactgcaagaaattaaatgtcggataatcctggctggtcattgcggcatgagccagttcattaattttttgcgtaataagctgctcatgctcataggtcgcgcggaacagttcatccagtgaggtgtactcagcgaagggcgaagaaacgctattaatgcgcggcaggcttccggtatcggtaaggtagtcaaacaggcgctgcatatgcgtcatctcttcttgcgcatggcgacgaagaaatgcggccgcgccttcaaaactgtgatagctacaccacgcgctcatttgttgatagagcagggaggagtacaactccagattcatttgctcattcagtttgtcgatcatttctgttttcagcatggttccgctccacaaatagcaaaagatatacggtaatgtggcgccactataatttgttattttattatttgcaaaaggtaaaatattaaatttaattattaaaaatacgaatgggaataaaacgcattaacgccagtgtatagcgtataaaaataaaggaaagccagcaccttcatgctggcaatagcgaccctgcactctcctctattgtacatggtgtcggcgttaagccagccgccttaataataaagcggcatgatttgcgggacggaaacgccccggcactgccaggagagggtaaatcgggtgttcagacacaacgagcccgcataaatgctacaggttcctaccggctgaccaaacgaaacggcatcggcatagcccatctgctggcattcgcgtgttgcggttccgtgagatacatagtcatctgtccgtgaagtaaaaaatagcggctggttatacgtcaggcgcacgatgccgcttatcgggctggcttcgctgacctgcgcttgtcgagtaatggtgcatcccgtcagggctagcagtgaaagagtaaaaataagaggcttcataaaatcgctccgacagttcggtatcagaccatgctacctcgtgtcttgcaccgtcaatggctggaataacttacggattcgccttgattaaaggtaacggcaggggatttacagcgggaacagaaaatgtgtgagcgtcttttcatttaatgaaactttgtttcattaaatttgaatgtgtgttcgtaaatgtgtagtgtaggcaaaacgtcatgatttatgcaggcgccacctctggcaaacagaccagaaacggtgtaggccggataagctgcttcgcgttgctatccggctaataacgtctcaatattgtcgctcggggtgccgctatcagtgatgctgataggtcacgacgttaaggagatgctgatcggtttgcgccaggcatagccctgctcgtttagcgctgcgaacttcttcgagaatagtttgtaaaagtacgccatcctgctgctgctctttttccagggtatggagaaaatcgagcgttgaggcatcattcagcgctttcgcttcatctgccagacgcgacagcgtgctggcgcgttgctgataatcctccagggttttctggaacaattcttccagagagcagagctcttcacccggaacgtcaatggctttaacgataggggtggcgccggcgtttttcataaaattaaacatgcgcatcatttgcgtcacgttgccttgcgcttgggtacgaagaaaggtggctgtacctgttaaactgtgttcagaacaccattcgcttagatggaggtaaagatttgatgcgtaaaactcaagattcattggcgtgttgagcttttgaaccattcctacagctgccataacaatatccttatttccagaaagtgttgatgtgcatgacagacgagaatgcaacggatcgttgtcacattcttacctctatgcacaataaatactcttagcagaagaactccgttccgccagtcccttatgcgatctcatttcctgtttatcgatcggtaatgagaatagcgcgtcaatgaaaataagaaaatccttaaatgcaattgtttatctttttttacattttcagctgtgtgattttttcatcagaaatgatttttggtatgtcattcttataactatttgaaagataaaagatattctattttttctggtttatgaaacattgtttcagatcataagataggcctttcaagtatggtaatttcaataaaataaacattagccagtctggatatcacacgcataaacggttgagagcaaatatgcctgtttttataaactagccgattttgcggtagatcatttttaatatcattaatcatacgagcacgttattcggttgagcgcagttttgctgggtgactcgttaacaaggagcagtcaatgaaaaaggtcgcggtgctactggcgccaggatttgaagaagcagaggccattgttactcttgatattctgcgacgtttgcatatcgacgtcgaaacgctggcgtgtgctgaatcacgggcggtggtgagttaccatgatattcctatggttgcggacagcacgctgagtgaacgccagcaggcgctttttgatgcggtagtgctgccgggcggtccgcaggggagcgctaatctggcggctaatccggcggtgatcgctttcgttgcgcgtcatgatgcggcaggcaaattaatttgtcctatctgttccgcggcggcaagggtgctgggtgctcacggattgctgaaggggcgtcgttatgtctgttccggcgacctgtggaaagcggttccggaaggtgtctatgtggatgcgcccgtggttgaagatggtaatttaattagcggcaaagggttgggtcatgtctttgatttcgcgctaaccctttccgccagactgctgggagacgatgcgctggttcgcgaacaagctgaacatatctattatccctggtaatcgttattcacccagggccgtaaggattagctggctgatgttatggattaatgtgctggctttcctgccttttggctgatgaattcgctctgggttatgtcattttccgctaaaactattccagccatcagcatttatctaatgaatgaaagacagtgcaccgttttacgtcttctctaacaagaatcgtttgattttaccctacataaaaaacgctaaagcaggtcaatgaattccctgggttatgagttaatcgttatttctgcgtgcgtattagggggcgttttcctgagaggcggcctcggaaaaatctcatatgtggtggcgagcgtactgatatcaggaacggtggagaacgcgatgaacctgctcaacatttcaccttttgcacagtacgtggttcgcggctgaatccttctggcagcagttatcttcgaccattataagcaaaaagcgaagcgtatgatttgatgaattaacactcaactaaacagtatagcttcacgtcatcgccaaccgctaccccggctggcgatggtctttctaaatggcgagcagcgtcacactgtctatacttacatgactaatgagaccgtttgtgagtctcaatatgatgataaggaggagaccagggtggcagaaccgttaaccgtatcccccgaactcactgcgaactatgcgtatttttttgaccttgatggcacattggcagagataaagcctcatcccgatcaggtagtggtaccgcataaaatccttcagttgttagaccgtctcgcggcgcacaacgcaggggcactggcattgatttcagggcgttcaatgactgagctggatgctttggcgaagccttttcgctttccgctcgctggcgttcacggggcagagcgtcgtgacatcagtggtaaaacccatatcgtgcgccttcctgaagcggtagtccgtgaggtggaggcgttattacgttcgacgcttgcagcgctgcccggaacggagctggagacaaaggggatggcgtttgcgctgcactaccgtcaggctccggaacatgaagcggcgctgttggcgcttgcgcaacacgttacgcagcactggccgcaactggcgttgcagcctggtaaatgtgttgtggaaatcaaacctaagggaactaataaaggcgaagcgattgccgcctttatgcaggaggcgccctttacgggacggattcccgtttttgtgggcgacgatttgaccgatgaggctggctttggcgtggtgaatcacgctggcggaatttccgtaaaagtgggcgtcggggcaacccaggcggcatggcggctggaaagcgtacccgatgtctggcgctggctggaacaaatcaattatccacaacaagaacaacaagtaatgaataacaggagagatggctatgagtcgtttagtcgtagtatctaatcgaattgcccccccggataataaaggcggcgccggcggcctcgctgttggcgtgcttggcgcgctaaaagcggctggcgggttgtggttcggctggagtggcgagacaggtaacgaggatgagccattaaaaaaggtgacaaaaggtaatattacctgggcatcgtttaacctgagtgaacaagattacgaagattattactgtcaattttccaatgcggttctctggccagcgttccactatcgtctggacctggtacagtttcagcgtcctgcatgggaaggctatatgcgggtgaatgcgttattagcggataagttattgcccctcattaaagagaacgacatcatttgggtgcatgactaccacctgttaccgtttgccagcgagctgcgtaaacgcggcgtgaacaaccgaattggttttttcctgcatattccattcccgaccccggagatttttaacgctttaccgccacatgatgaactgctggagcagttgtgtgactttgatctgctcgggttccagaccgaaaatgatcgcctggcttttctggatagcctttcgagtcaaacgcgagtcacgactcgcagcggcaagcagcatatcgcgtggggtaaagacttccagacagaagtgtatcctatcggtattgagcccgatgagattgctctgcaggctgccgggccgttgccgccaaaactggcgcagctcaaggcggaactgaaaaatgtgaagaatattttttccgttgagcggctggattattcgaaagggctgccggaacgttttctggcgtatgaagcgctactggaaaactatccgcagcatcggggaaaaattcgttatacccaaattgcgcctacgtcacgcggcgaagtacaggcatatcaggatattcgccaccagcttgagacagaagcaggccggattaatgggaaatatggacaattgggctggacgccgctctattatctgaatcagcatttcgaccgtaaactgttaatgaagatattccgttattcagacgtcgggctcgtcaccccgttgcgtgacgggatgaacctggtggcgaaagagtttgtcgccgcgcaggaccccgctaatcctggcgtactggtactgtcacagtttgccggcgcggcgaatgaactgacgtcggcgttaatcgtcaatccttacgatcgggatgacgtggcggcggcgctcaatcgtgcgttaacgatgccccttgccgagcgtatttcgcgtcatgcggaaatgctggacgtgatcgttaaaaatgacattaaccgctggcaggagcgttttattcatgacctaaaggaggtcacgccgcgtagccctgagcgtcagcagcagaacaacgtggcgacgttccctaagctggcctgagatatcgcgagcggcgactagtcgcccgctaacggcaccagcaacacatctacctggctggcgctgacgacacttttgccgagcaggacgcgcgcgaaaagaaactgtggttatggttgccgcaaatgaccagatcaacatggtgtttgcggcacacagccaaaatatgctggcttaactcacctgatgcgatgaaagtttgttcaatcggataatccgccttttcccccagcattttaagaaaattctcggtctcttcatgcataaccgcgcgtaaatcctccatcatgggcgcggcgaactggttatacagttcaggatcggaagcgagagtaatcaggcttactttcgcctgaacagggcgggcgatagagaccgctttagccagtagctggtgactttccggggtgacggcaacggcgacaagaatatgggtgtagctcataactcgctccttgattgcaagaatatgagattgtgctttagctttactctgtttatcgcatttctgcaatgcgctaatgccacattaatgtgaaggacatcataattaatcattgattattcttatgtaaagaatcgtggcataagacactttttacacaccaccaggatgctttatttaaacgggtgaacaaggaaagctaaaagttaaatcaaatgagcttatttttaacagaggagggcgtatgctgtgacgagattaattaataacgtttaatatttaagccactgtttactaaaggtaaaataaaattgtttctaaaatagaaataatagcctgttatctattatcctggcgttattttaacagagagaaacaaaaaagaatttggtgttgacgtacccctattcagcagtgtggaatagaaaaagtgaatattaggttattaattaaacaaagtaaaagccatactgatggttttatcgtaagtattctgttaaattatgtgatctgcatcgcatattttctaaaatcgccgtcccgctccgttgtatgtcacgaaactgacgagtagagttgcgtcgaattaggaaaaatcttaggcatttgtaaaaattgatgtaaacgtgtaaggcgaatcccagtgggaagctgcgttatacgtcacaatgtccataatgtctgagcgctgctatgcatttgacctttttgcttcttttaccgggccttcccggcgacatcacggggtgcggctacgtcgcacaaaaataaagttggttattctggatgggaacaatgcatacatccgagttgctaaaacacatttatgacatcaatttgtcatatttactccttgcacagcgtttgatcgtccaggataaagcatctgcgatgttccgcctcggtatcaacgaagagatggcaaacacactgggcgcgttgaccctgccgcagatggtcaaactggcggagacgaaccagttagtttgtcatttccggtttgacgatcatcagacgatcacccgtttgactcaggattcgcgcgtcgatgacttacagcagattcacacaggtatcatgctttcaacgcgtctgctcaatgaagtggacgatacggcgcgtaagaaaagggcatgataatgagcgaaaaaagcattgttcaggaagctcgcgatatccagttggcgatggagttgattaatcttggcgctcgtctacaaatgctggaaagcgaaacacagctcagccgtggtcgcctcatcaggctgtacaaagaattacgcggtagcccgccgcctaaagggatgctgccattttcgacagactggtttatgacctgggagcaaaatattcatgcctccatgttctgcaacgcctggcaatttttactgaagaccggcttatgcagcggtgtggatgcggtgattaaagcttatcggctttatcttgagcagtgtccgcaaccgcctgaagggtcgttgttggcgctgactcgcgcatggacgctggtgcgttttgttgaaagtgggttgcttgaattgtcgagctgtaactgctgcggtgggaactttattacccatgcgcatcagcccgtaggcagctttgcgtgtagtttatgccagccgccatcccgcgcagtaaaaagacgtaaactttcccgagatgctgccgatattattccacaactgctggatgaacagatcgaacaggctgtttaaccgaaacggtgtggacaaacactccagcagcggtaagccattaccgctgctttttttttttgccttgccttcgcgttaatcgcccgactgcgcatcctgtcatagtcaacagcggaaggatgatgtcgtgcttatcttattaggttacttggtggttatcggtacagttttcggcggttatgtcatgaccggcggacaccttggggcactctatcaacctgctgaactggtcatcattggcggcgcggggatgggggcgttcattgtcggcaacaacgggaaggccatcaaaggcacgatgaaagcgatcccgttgttatttcgccgttcgaaatacacgaaatctatgtacatggatttgctggcgttgctctatcgcctgatggccaaatcacgccagcaggggatgttctcccttgaacgcgatattgaaaatccgaaagagagtgaaatcttcgccagttatccgcgtattctggccgatgcggtaatgcttgattttattgtcgattatctgcgtctgatcatcagcggcaacatgaatacgttcgaaattgaagcgttgatggatgaagagattgaaacccatgaaagcgaggcggaagtcccggccaacagtctggcgatggtgggggattcgctgcctgcctttggtatcgtcgcggcggtaatgggggtggttcacgctctggcttcagccgatcgtccggcagcggagttgggggcgctgattgcccatgccatggtaggtacgttcctcggtattttactggcttatggattcatttcaccgttagcgaccgttttgcgccagaagagcgccgaaaccactaagatgatgcagtgcgtaaaaattacactgctgtctaatctgaacggctatgcgccgccgattgccgtggaatttggtcgtaaaacgctttattccagtgagcgtccatcgtttattgagttggaagaacacgttcgcgcagtgagaaacccaaaccagcagcagacgactgaggaagcatgaaaaatcaggctcatcccattgtcgtcgtaaaacgccgcaggcacaaaccgcacggcggcggggcgcacggttcctggaaaattgcctacgccgattttatgacggcgatgatggctttttttctggtgatgtggctgatttccatctccagccctaaagaattaattcagattgccgaatattttcgtacgccgttggccaccgcggtaacggggggaaatcggattgccaatagcaagagcccgataccaggcggcggcgatgattacacccaacagcagggtgaagtggaaaagcagccgaatatcgacgagctgaaaaaacggatggagcagagtcggttaaacaaactgcgcggcgatctggatcaactgatcgaatccgatcccaaactgcgcgcgttacgtccgcatctgaaaattgatttagttcaggaggggttgcgcatccagattatcgacagccagaaccgcccgatgtttaaaaccggcagcgccgaagttgagccgtatatgcgcgatatcctgcgtgcgattgcgccagtgttaaacggtatacctaatcgcattagcctggccggccataccgatgactttccctacgcgaacggcgaaaaaggctatagcaactgggagttatccgccgatcgcgccaatgcctctcgtcgcgaactggtcgctggcgggctggataacggaaaagtattacgggtggttggcatggccgccacgatgcggctgagcgatcgcggtcctgatgacgccatcaaccgccgtataagcctgctggtgttaaacaaacaggcggaacaggccattttgcatgaaaacgctgaaagccagaatgagccggtaagtgtattacaacagcctgcggcagccccgccggcaagcgtacccacatcgccaaaagcggaaccgaggtgatagcgtgagcatggatattagcgatttttatcagacattttttgatgaagctgacgagctgttggctgatatggagcagcatctgctggatttggtgccggaatccccggacgctgaacaactgaacgccatttttcgcgcggcgcactccattaaaggcggcgcgggcacattcggcttcactattctgcaggaaaccacacatttaatggaaaacctgctggatgaagcccgacgcggtgaaatgcagctcaataccgacattatcaacctgtttttggaaacgaaagatattatgcaggaacagctcgacgcctataaaaactccgaagagccggatgccgcaagcttcgaatatatctgcaatgcgctacgccagttggcgctggaggcgaaaggcgaaaccacgccggcggtcgtagaaaccgcggcactaagtgcggcgatccaggaagagagcgtagccgaaaccgaatcgcctcgtgacgagagtaaactgcgcattgtactttcacggttgaaagccaatgaggtcgatctgcttgaagaagagttgggcaatctggctactctgacggatgtcgttaagggggcggattcactgtcggcaactctggatggcagcgtcgcggaagatgacattgtcgcggtgctctgttttgtcatcgaggccgatcagatcgcttttgaaaaagtggtcaccgcgccggttgaaaaagcgcaagagaaaaccgaggtagcaccggtagcgtctccggcagtcgttgcgccagccgccaaaagcgcggcccatgaacatcatgcggggcgtgaaaaacctgcgcgtgaacgcgagtccaccagcattcgcgtggcggtagagaaagtggatcagctcataaacctggtcggcgagttagtgattacccagtcaatgttggcccagcgttctaacgagctggacccggtaaaccacggcgatctcattaccagtatggggcagttacaacgtaacgcccgcgacttacaagagtcggtgatgtcgattcgtatgatgcctatggagtacgtcttcagccgtttcccgcgtctggtacgcgatttagcgggcaaactgggcaagcaggtagagctgacgctggtggggagctccactgaacttgataaaagcctgatcgaacgcattatcgacccgctgacgcacctggtgcgcaacagtctcgaccacgggattgaaatgccggaaaaacgccttgaggcggggaaaaatgttgtcggcaatctgatcctttctgcagaacatcagggcgggaatatttgtattgaagtgaccgatgacggcgcggggcttaaccgtgagcgtatcctggcgaaggccatgtcgcaggggatggcggtgaatgaaaacatgaccgacgatgaagtaggcatgttgatcttcgcgccgggattctcaactgcggaacaggtcacggatgtctccggtcgcggcgttggcatggatgtggtgaaacgtaacattcaggagatgggcggtcacgttgagatccagtcaaaacaaggctccggcaccacgattcgtattctgctgccgctgacgctggccatcctcgatgggatgtcggttcgcgtggcgggggaagtttttatcctgccgttaaatgcggtgatggagtcgctgcaaccgcgtgaagaggatcttcatccgctggcgggcggcgaacgggttctggaagttcgcggcgagtatttgccgctggtcgaattgtggaaagtgtttgacgtggacggggcgaaaaccgaatccacgcagggcattgttgtgatcctgcaaagcgcgggacgccgttacgcgctgctggtcgatcagctcatcggtcagcaccaggtggtggtcaaaaatctggaaagcaattatcgcaaggtaccggggatttccgccgcgacgatcctgggcgacggcagcgtcgcgctgattgttgatgtttccgcattgcagggtttaaaccgcgaacaacgtatggcgatcacagccgcctgattgagtgagaagggaataatatgaccggtatgagtaatgtaagcaaactggccggcgagccgtcaggtcaggaattcctggtgtttacactgggaaatgaagagtacggcatcgatatcctgaaagtgcaggagatccgtggctatgaccaggtgacgcgcatcgccaatacaccggcctttataaaaggggtgactaacctgcgcggcgtgattgtccccattgtcgatctgcgcgtgaaattctgcgaaggcgacgttgagtatgatgacaatacggtagtgatcgtactgaatctggggcaacgtgtcgtcgggatagtggtaggcggcgtgtctgacgtactgtcgttaacggcggaacagatccgtccggcgccagaatttgccgtgaccttgtcaacagaatatttgacgggattgggcgcgctcggcgagcgtatgctgattctggtgaatatcgaaaaactgcttaacagcgaagagatggcgctgctggatatcgcagcatcacacgtcgcgtaataacgttgccggatggcgtcgcgccatccggcaatattcaccgttatgcttccgccagcggtgagagtgcctcttcatcgcccgcgcccagcccctgcattttgcgccggcatcgccgctgcgacactgtcattggcaatgtcgtcttccggaacagcgtatttcctttttgcaaaagtaaagttatcaccgcaggtgccgataacgttgataactcgttatcaggaaggtgccttatgtttaaccgtatccgcgttgtcacaatgctgatgatggtgctgggggttttcgcactgctacagcttgtttccggtggtttgctgttttcttcattacagcataaccagcaaggttttgttatttctaacgaattacgccagcaacaaagcgaactcacgtcgacatgggacttaatgctgcaaacgcgcattaacctgagccgctccgccgcacgcatgatgatggacgcttctaaccagcagagcagcgccaaaacggatttactccagaatgcaaaaacgaccctcgcacaggcggcggcgcactacgccaatttcaaaaacatgacgccattgccagcgatggcggaggccagcgcgaacgtcgatgaaaaatatcagcgctatcaggccgcattagccgaacttattcagtttctggacaatggcaatatggatgcctacttcgcccagccaacccagggaatgcaaaacgcgttgggcgaggcgctgggcaattacgcccgggtgagcgaaaacctgtaccgccagacatttgatcaaagtgctcatgactaccgttttgcgcaatggcaactgggggttcttgcggtcgtgctggtgctgattttgatggtggtttggttcggcattcgtcatgccttgcttaacccattagcgcgagtgattactcatatccgtgaaattgccagcggcgatctgacgaaaacgctcaccgtctcaggacgtaatgaaattggcgaactggcgggaacggttgaacatatgcaacgctcgctgattgacaccgtgacgcaggtttgtgaaggttcggatgcgatttattccggcaccagtgaaattgccgccggtaataccgacctctcttcccgtaccgaacaacaagcctccgctctggaggagacggcggccagcatggaacaactgacggccaccgtgaagcaaaacgccgataatgcccgtcaggcttcgcaactggcgcaaagcgcctccgagaccgcgcgtcatggcggcaaagtggtcgacggcgtagtaaacactatgcacgaaattgccgacagttcgaaaaaaatcgctgacattatcagcgttatcgacggtattgccttccagactaacattctggcgctgaacgcggcggtagaagcggcgcgcgcgggagagcaggggcgcggttttgcggtcgtggcaggcgaggtgcgtaatctggccagccgcagtgcccaggcggcgaaagaaataaaagcgttgattgaagattccgtctcgcgtgtcgataccggttcagtgctggtggaaagcgccggggaaaccatgactgacatcgtcaatgccgttacgcgcgtcacggatatcatgggcgaaatcgcctccgcctcggatgagcaaagccggggtatcgatcaggtcgctttggccgtttccgaaatggatcgcgtaacgcaacagaacgcctcgctggttcaggaatccgcagcggccgccgccgcgctggaagagcaggccagccgtctgacccaggcggtatcggctttccgcctggcatcgcgaccgctggcggtaaataaacctgagatgcgtttatcagtggacgctcagtccggcaatacgccgcggcccttagccgccggggatgatgcgaactgggaaaccttctgatcgatgtgcgctgtgtgctgtcggttatcgattaatttgcgaacccgccgatccctttcgtctggttcgcatagataaaagcaaaaaatgtgtaatacgggaagcatggcgctgccgcagggcgcgcccgttgtactttgaatgtgattaagaaggcgctatgacatcatctctgccctccgggcaaacgtcagtattgttacagatgacacagcgcctcgcgctgtccgacgcgcattttcgtcggatatgtcaattaatctaccagcgtgcagggatcgtgctggccgaccataagcgggatatggtttataaccgcctggtccgtcggctgcgtgccctgggactggatgattttggccgttatctcagtatgctggaggctaatcaaaacagcgttgagtggcaggcttttatcaacgctctgactaccaacctgaccgctttttttcgcgaggcgcaccattttcccatccttgcggaacatgcgcgtcgccgccacggcgagtaccgcgtctggagtgcggcggcatcgacaggagaagaaccttacagtatcgccattacgctggcggatgcgttagggatggcccccggtcgctggaaagtattcgccagcgatattgatactgaagtgctggaaaaagcgagaagcggtatttatcgcctcagcgaactgaaaacgttatcgccgcagcagctacaacgttacttcatgcgcggtacggggccgcatgaaggactggtgcgcgtgcgtcagcaactggccaattatgttgaattttcctccgttaatttattggaaaagcagtacaacgtacccggtccctttgacgcgattttttgccgtaacgtcatgatctattttgataaaacgactcaggaggacattctgcgccgttttgttccactccttaaacctgacggactgttgtttgccggtcactcagaaaactttagcaacctcgtgcgcgagtttagcctgcgcggacagacggtgtatgcgctaagtaaggataaagcatgagtaaaatcagggtattgtcagttgatgattccgcgctaatgcgccaaatcatgactgaaattattaatagccatagcgatatggagatggtagcgactgcgccggacccgttggtcgccagggatctcatcaaaaaatttaatccggacgtattgaccttggacgttgagatgccgcgtatggacggcctcgattttctggaaaaactgatgcgcctgcgaccgatgccggtggtgatggtctcttcgctgaccgggaaaggttccgaagtgacgctacgggcgctggagttgggggccatcgattttgtcaccaaaccgcagcttggcattcgtgaaggtatgctggcgtatagcgagatgattgccgaaaaagtgcgtaccgccgcgcgggcccgcatcgccgcacataaaccgatggcggccccgacaaccttaaaagccggtccgctgctcagttcggaaaaactgattgctatcggcgcttcaacgggcggtactgaagctatccgacatgtgctgcaaccgctgccgctttccagtccggcagtgattattacgcagcatatgccgcctggctttacccgctcgtttgccgagcgcctgaataaactctgtcaaatcagcgtgaaggaggcggaggacggcgaacgcgtattgccaggtcatgcctacattgcgcccggcgacaagcatatggagctggcgcgtagcggggcgaattatcaaatcaaaattcatgatggcccgccggtaaaccggcatcggccttccgtggatgtgctgtttcattcggtggcgaaacacgcggggcgcaacgccgtaggcgtcattcttacggggatgggcaacgatggcgccgctggaatgttagcgatgtaccaggctggcgcctggaccattgcgcaaaacgaagcaagttgtgtggtgttcggcatgccgcgcgaggccatcaatatgggtggcgtaagcgaagtggtcgatcttagccaggtaagccagcagatgctggcgaaaatcagtgccggacaggcgatacgtatttgaaccaggagtagtattttatggcggataaagagcttaaatttttggttgtggatgacttttcgaccatgcgtcgtatcgtgcgcaacctcttaaaagagcttggatttaacaatgtggaagaggccgaagacggcgtcgatgcgctgaacaagctccaggcaggcggctttggttttattatctctgactggaacatgccgaacatggatggcctggagctgctgaaaaccattcgcgccgatagcgccatgtcggcgttacccgtgttgatggtcacggcggaagccaagaaagagaatattatcgccgccgcacaggctggcgccagcggttatgtcgtaaaaccgttcaccgcagcgactctggaagagaagctcaacaaaatctttgagaaactgggcatgtgaggatgcgatgatgatgcaaccatctatcaagcctgctgatgaaggctcagcaggagacatcattgcgcgcatcggtagtctgacccgaatgctgcgcgacagcctgcgtgaactggggctggaccaggcgattgccgaagcggcggaggcgatccctgatgcgcgcgaccgtctggattatgtcgtccagatgacggcgcaggcggcggaacgcgcgctaaacagtgtcgaagcctcgcagccgcatcaggatgcgatggaaaaagaggcgaaagcgctaacccaacgttgggacgagtggtttgacaatccgatcgagctttccgacgcccgtgaactggtgacggatacgcgccagtttctcagggatgtcccgggccataccagctttactaacgcgcaactgctggacatcatgatggcgcaggatttccaggatctgacgggtcaggtgatcaaacgcatgatggacgtgattcaggagattgagcgccagttgttaatggtgctgctggaaaacatcccggaacagagcgcgcgaccaaaacgcgagaacgaaagcttgctcaacggcccgcaggtggatacctcgaaagctggcgtcgtcgccagtcaggagcaggtggacgacctgctggacagtcttggcttttaagcttttttgacctgatggcgctgcgcttatcgggtccgaatccgtcaacccggccggatacgatactttcttatcgtatccggctatctctattaacgccataaaccccgccttttttaccgcttactctgcccattggcgtaaagcggttctggcatcattctcgcttatcaatctatccagggtttgctgcgtggcagaagagagcgacgacgacaaaacagaagcccccacaccccaccgacttgaaaaagcgcgggaagaagggcagatcccccgttccagagaactgacctcactgctgatattgctggtgggcgtttgtattatttggttcggcggcgagtcgttagcgcggcagctggcgggaatgctctcagcaggcctgcacttcgatcaccgtatggtgaacgatcctaacctgatcctggggcagataattttgctgattaaagcggcgatgatggcactgctaccgctcatcgcgggcgtggtgctggtggcgcttatctcgccggttatgcttggcggcctgatttttagcggtaagtcgctacagccaaaattttctaaattaaacccgctgccgggaattaagcgcatgttttcggcgcagaccggcgcggaactgctaaaagcggtgttgaaatccacgctggtcggctgcgttaccggcttttatctctggaatcactggccgcaaatgatgcgcctgatggcggagtcgccgatcgtcgcaatggggaatgcgctggatctggttggactctgcgcgttactggtggtactgggcgtgatcccgatggtgggatttgacgtttttttccagatctttagccacctgaaaaaattacgcatgtcgcggcaggacattcgcgacgaatttaaagagagcgaaggcgatccgcatgttaagggcaaaattcgccagatgcaacgcgccgccgcgcagcgccgcatgatggaagatgtgccgaaagcggacgtcattgtcactaacccgacgcactattccgtggcgctgcagtatgacgaaaacaaaatgagcgcgccgaaagtggtcgcgaagggggctggattaatagcgctgcgcattcgcgagatcggcgctgaacatcgggttcccactttagaagcgccgccgctggcgcgggcattatatcgccacgccgaaatcggtcagcaaattcccgggcagttatatgctgccgttgcggaagtgttggcctgggtctggcagcttaaacgctggcggcttgcgggcgggcaacgtcctccacaacctgagaaccttccggtgccagaagcgctggattttatgaacgagaagaatactgatggctaatctggtcgcgatgctgcgcctgcccagcaacctgaaatcgacgcaatggcaaattcttgccgggccgatcctcattctgctgattttgtcgatgatggtgctgccgctacctgcttttatcctcgacttattgtttacctttaatattgcgctatcgatcatggtgctgctggtggcgatgtttacccagcgtactctggattttgccgcgtttccgaccatcctgctgtttaccacgctactgcgtctggcgcttaacgttgcctcaacgcgcattattttgatggaagggcataccggcgcggcggcggcgggaaaggtggtagaggcgttcggtcatttcctggtcggcggtaacttcgcgatcgggattgtggtttttatcatcctcgtcattatcaacttcatggtcatcaccaaaggtgccggacgtattgccgaagtcggcgcgcgctttgtgctggatggtatgcccggtaagcaaatggcgattgacgccgatcttaatgccggtctgattggtgaagacgaggccaaaaaacggcgttcggaagtcactcaggaagccgacttctacggttcgatggacggggcaagtaaatttgtacgcggcgacgccatcgccggtattctcatcatggtcattaacgtggtaggcgggctgctggtcggcgtattacagcacggaatgagcatgggcagcgcggcggaaagctacaccctgctgaccattggcgacggcctggtcgcccagatcccggcgctggttatctccacggcggcgggcgtcattgtgacccgcgtcagtaccgatcaggatgtaggcgagcagatggttggccaactgttcagtaatccaagggtaatgctgctggcggcggcggtgctggggctgcttggcatggtgcctggaatgcctaacctggtatttttactctttaccgccgctttgctcggcctggcatggtggctgcgcgggcgtgaagaaaaagcgccggaggagccgcagccggtaaaaatgccggaaaataactcggtggtcgaagccacctggaatgacgtacagcttgaggattcactgggaatggaagtgggctaccgcctgatcccgatggtggattttcaacaggatggcgaattgctcggacgtattcgcagtattcgtaaaaaattcgcgcaggatatggggttcctgccgccggtggtccacattcgcgacaatatggatttacagcctgcgcgctaccgtattttgatgaaaggggtagagatcggcagcggggacgcctatccgggacgctggctggctattaaccccggcacggcggcgggaacgctaccgggcgagaaaaccgtcgatccagcttttggccttgatgccatctggattgaaagcgccctgaaagagcaggcgcaaattcagggctttaccgtcgtggaagccagtaccgttgtggcgacgcaccttaaccacttgattggccaattctccgccgaactgtttggccgccaggaagcgcagcaactgttggatcgtgtctctcaggagatgcctaaactcacggaagatctggtccccggcgtcgtgaccctcacgactttacacaaagtcctgcaaaacttactggcggaaaaagtccctattcgcgatatgcgcaccattctggaaacgctggcggaacatgcgccgttacaaagcgatccgcatgaattaaccgccgtggtacgcgtggcattagggcgagcgattacgcaacagtggttccccggtaatgaagaagtgcaggtgattggcctggataccgcgctggagcgtttgctgcttcaggcattgcagggcggcggtggacttgagcctgggttggcggatcgcctgctggcgcagacccaagaggcactttctcgccaggaaatgcttggcgcgccgccggtattactggttaaccatgcgctacgtccattattgtcccgctttttgcggcgcagtttaccgcagctggtggtgttgtcgaaccttgagctttccgataaccgtcatatccgcatgacggcgaccattggaggaaaataatgcgtaaatggctggcattgttgctctttcccctaacggttcaggccgcaggcgaaggcgcgtggcaggatagcggtatgggcgtaaccttaaattaccggggcgtttccgcatcgtcttcgccattgtcggcgcgccagccggtttccggtgtgatgacgctggtcgcctggcgttatgaactgaatggcccgacccccgcaggattacgggtacgtttatgttcccagtcccgttgcgtagaacttgatggtcagagtggcacgacccacggttttgctcatgttcccgcagtcgagccgctccgctttgtctgggaagtccccggcggcggcagacttatcccggcgttaaaagtgcggagcaatcaggtgattgtgaactaccgctaaccgcccctttctttgccaggtagcagacctgactctctttttgaataaatagaaacgtcgttttataaaatggtgaggtaggttgccggactctttgcgtttttgccatttacgctctgacaatggcagaaacaaaaaggtttccgcccagcttagcttttactgtagcgaatcgactgcgtcggcggtaaaactgcacgcagcactgaattcgacattacacagaggttaagcaaatgatggtttatccagtcaaacacagtccgctattgcgtcagcctgagcattttatcgccagagatgaactaaaagccctggtgcaaaaggtgacgcataacctggtcaatattaaagatgagacaggcgaatttttattgcgactggacgacggacgcgtgatcgatactaaaggctgggccggatgggagtggacgcacggcgtgggcctgtacggaatgtatcactattaccaacagaccggcgaccagacgatgcgtaagatcattgatgactggtttgccgatcgctttgcggaaggcgcgacgacgaaaaacgttaatacgatggcgccgtttttaacgctggcgtatcgctatgaagagacgcgtaatccagcgtatttaccgtggctggaaacgtgggccgaatgggcgatgaatgaaatgccccgtaccgattacggcggaatgcagcacatcacgctggcggaggaaaatcatcagcagatgtgggacgacacgctaatgatgacggtgctgccgctggcgaaaatcggtaagctgttgaaccggccggaatatgtggaagaggcaacctatcagttcctgctacacgtgcagaatttgatggataaagagacggggctgtggttccacggctggagctatgacggtcatcataacttcgctaacgctcgctgggcgcgcggcaacagctggctgaccattgtggtcccggattttcttgaactgctggacttgccggaaaataatgccgtgcgccgttatctggtccaggtactgaatgcgcagatcgccgcgctggcgaaatgtcaggatgaaagcggtttgtggcatacgctgcttgacgatccgcactcttatcttgaggcgtcggcgacggcgggttttgcctacggtattcttaaagcggtgcgcaaacgctatgtcgaacggcactatgcgcaggtggcggaaaaagctattcgggggatagtgaaacatatctcgccggaaggcgaactgctgcaaacatcatttggcactggcatgggccacgatctcgatttttaccgtcatattccgttgacctctatgccttacgggcaggcgatggcaatgctgtgtttgacggaatatctgcgtaactatttctgatgtatgcagatattccggtcgtatccttgtctgatggcgctttgcttatttgactatggcgcctgacccgactgtgtggtatcagcctgtggatcaaacaggtggtcaaggatttttcgcatgatgggcgcggcggtaacgccgtcgcttccgccgttttccagaatcaaggcaatagcgaccttagggtttttatacggtgcaaaagcggtataaaacacatgatcgcgcaggcgaatggggatcattttcgcattgtaggtctgattttctttcaggctaaacacctgcgacgtgccgcttttggccgcaatgccgtagggcgcggtgtgaaagaacttatagcccgttccgttgggtgcattcgccatgccgtacatcgcctgacgcaccagtccccagtatggcgacgccggatcggctatctgtgccggtgttcctgaaggacgatacggaaccaccgttttgccgctctcttcattgagtaacaggtgaggggcaatcaccttactgttgttgatgagcgccaccatcgcttttaccatctggatgggggtggcaatccagtagccctggccgatgccgacagagatggtatcgccctgataccaggcttttttatggacccgctgtttccatgcgcggctgggaagcagcccgtcatactcttcactaaggtcgatacccgtcggtttgccatagccgaactgagacaacatcgtgtcgatacggtcaatacccatcatataagcgacctaatagaaaaaggtatccgcagattcctcaatcgctttagtgacatccagcataccgtgtccggtttttttccagtcccggtaatgacgctgcgtgccgggaagcgtccaggttggcgcgccaaagaaggtggtttgcggcgtaataatcccgcataacagcgcggacatcgccatatagggtttaaccgttgacgccgggggataaagcccttgcgtcacgcggttgatcagcggcagatttttatcgtgcagcagtttgccgtaatcctgatagctaatgccttttacaaaggggttcgggtcgtagctgggcatagataccatcgctagcactgaaccatcgtgcggatcttcaaccagtacggcagcacgctgcccggccagcaaactttcaatgtactcttgtaaatggagatccaacgtcaggtgaatgttcttacccgcgatgggaggaacgtctttcagcaggcggacaatacgcccgtgattatccacctcgacctcctgataaccggttttgccatgaagatcgttttcgtagtaacgctcaatcccctgtttaccgatgttatggtccgccgcgtaattctctgccagcccttttttatccagcgctttaaggtcgttatcgtttatctttgacacgtaaccgagaacatgcgccagctccgcgccgtaaggatactgccgatcctgatagctattgatcgtgacgccgttgaaatgaaactgattgaccgcaaagcgtgcgatttcaacatccgttagcgcgtttttgagcactaccggacgatagcggctactggattttagcgcgcggcgaaagtcggcgatatcgtcgggggagagatcaacaataggggtgagctgttttagcagcgcatccatatcggcaattttatagggcgtaaccgcgatatcataccaggttacgttacgcaccagcggaatgccgttgcgatcgtaaatgatgccgcgcgtgggcgcgacgggtagcatcttgatatcgttctcattcgaacgggtggtgtagtagtggtgctggcggatttgcaagttatagaggttgaagatcaggataccaaagcagacaaccactacaccaaacgccacaatcacacgtctcaggaagagtttctcttccgcatcaaagtctttaaaagtcattacctgtacctgaacaatccgccgcctaatgatacggggcggtcagcgccagcacaggtaaaagatgttccatctctctatagaaatgtgtcattccttgtgatttgttacagatataccgctgtggcaataaaaaggcctgagtccgttacccggagtcaggcctgatgatgttaacgacggcgcgtttacatgcgttctacggtttcgatacccaacgtatccagacccagtttcagcgtcttcgccgtcagttgcgccagttttaggcggctattgcgaaccgcgtcattctcggcgctgagaatagggcagtgctcgtagaagccggagaacagcccggcgacgtcatacagatacgcgcacatgacgtgcggcgtaccttcacgcgcgaccaccgtcagggtttcttcaaactgcagcagacgggcagcgagctgcgcttcgcgatcttcgctaatgataaccggcgcgctcgccagcgcctgctcgtcgatgtccgctttacggaaaacagacagcacacgcgtataggcatactgcatataaggtgcggtattgccttcgaaagccaacatattatcccagtcgaagatatagtcagtggtgcggttttttgacagatcggcgtatttcaccgcgccaataccgacggcgttagccagtttttccagctcgtcagccggcatatccgggttcttctccgccaccagacgacgcgcgcgctccagcgcctcatccagcaggtccgccagtttcaccgtaccgcccgtgcgagttttaaacggtttaccgtctttacccaacatcatgccgaacatgtggtgttccagcggaacggaatccggcacataaccggctttacgcacaatggtccaggcctgcatcaggtgctggtgctgacgggagtcaatgtagtagagcacgcggtcggcgtgcagcgtttcgtaacggtatttggcgcaggcgatatcggtagtggtatacagataaccgccatctttcttctgaataatgacgcccatcgggtcgccttccttgtttttaaactcatcaaggaaaaccaccgttgcgccttcgctttcaaccgccaggcctttggctttcagatcggcgacgatgcccggcagcatcggattatacagactttcgcccatcacatcgtcacgcgtcagagtgacgttcagacgatcataggtgatctggttttgcgtcatcgtgatatcaaccagcttacgccacatctcacggaaataggtatcaccgctctgcaatttgacgacgtagttacgcgcgcgctcggcaaacgtttcatcttcgtcataatgttttttcgcatcgcggtaaaatccttcgagatccgccagcgccatgtcgcccgcgttttcctgctgctgtttttccagccaagcgataagcataccgaactgggtgccccagtcgccgacgtggttagcgcgaataacatgatggcccagaaactccagcgtgcgcactgccgcatcgccaatgatcgtggagcgtagatgaccaacgtgcatctctttcgcgacgttgggcgcggagtagtcgacgacaatcgtctggcgagtcggctgagaaacgcccagacgatcggaggtcagcgcctgttgcacctgttcagcgagaaaagccggttcgaggaaaatattgataaagccagggccggcgatttcaaccttgctggcgatgccgctgagatccagatgagtcagcacctgctctgcaagttgtcggggggccatacccagttttttcgcaactgccatcatgccgttggcctgatagtcgccgaactgaactttggctgactgacgaacctggggctcgcaatctgcaggcgcgcctgcagcaatcatggcctgactaactttttctgagagaagagcctgaatattcaccggaataccttacgtttatgaagcggactgtattgcccgcgccagtttaagaattagggcgggagtatactgcaaatgcccgttggcgtcagcattgcgcgcgcggcgcgtcgcctgaaatatacgcaacaataatctgcataagcattcaataaacgcccaatcaaatcaaaggttggttgccggggcgcaacagcgtaaattagcggttttcacagcaagaagagcgtcctgatatggcgaactggcaacacattgatgaactgcatgatatttccgcagatttaccgcgattcactctggcgttcagagaactttccactcgccttggtctgcagattaacgcccttgaggccgatcacatttcattgcgctgtcaccagaatacgacggcggagcgttggcgtcgcggttttgaacaatgcggcgagctactgtcggaaaatatcatcaacggcaggccgatttgtctgtttaaactgcatgaaccggtatgtgtggaacactggcggttttctgttattgaattaccgtggccgggagaaaaacgctatccacacgaagggtgggagcatattgaaatcgtgctgcccggcgagccggagaccttgaacgcgagggccctggcgttgttgtcggatgaggggcttagtcagccggggatcgtggttaaaaccagttcgccacagggcgagcatgaacgtttgccaaaccctacgctggctgtgaccgatggccgcgtcacggtaaaatttcatccatggtcgattgaagcgattgtcgccagcgaacaggcggcccattaacctgccgagcggagtgaatatggcgttacttgagatctgttgttacagcatggaatgcgcgctcaccgcgcagcgaaacggcgcggatcgtatcgaactgtgcgccgcgccgaaagaaggggggcttacgccttctttcggcatcttacgcagcgtacgcgagcatattacgattcccgtacatccgattattcgtcctcgcggcggagatttttactacactgacggcgaatttgccgccatgctggaagatatccgtctcgtcagagagttggggtttcccgggctggttactggcgtgttgaccgttgatggggatgtcgatatgtcgcgaatggaaaaaataatggcggcggccgggccgctggcggtgacattccaccgcgccttcgatatgtgcgctaatcccttcaatgcgctaaagaatctggctgacgcaggcgtagcaagagtactgacttccgggcaaaaagccgatgcggcgcaaggtttatcaataattatggaacttattgcccagggggatgctccaatcattatggctggtgcgggggttcgtgcaaataacctgcagaatttcctcgatgccggagtacgggaagtacacagttccgccggagtcttactgccttcgccgatgcgctatcgcaatcaggggttatcgatgtctgccgatatacaggcggacgagtattctcgctatagggtagagggtgcggcggtcgctgagaatgaaaggaatcattgttcgccatcaggccaaatgatttttaccgttgcatcatgtcgcccaatatgatgcttgctcgtaccaggcccctgccaattcaacaggggcctttttttctccttcatatttcaagccgcagcagcgttggccgcctcgcgcaccccggtcacgtagctacctacgttcccggggatttgctgcgttgccgccttgctgcaacttgaactattttggagaaacggtgctatacgtaacggtcattcggcaatccatcacggtttacgcgcaatcagcaccgcgcgctgcggggcgggatagccttccaccgtcttgctgcgatcgttcgggtcaagaaaatcggccagcgactcggtaaccatccattcggtacggcgctgctcttcggtggtagtgacgcaaacgtcagcgatacgcacatcaacaaagccgcatttttccagccatttttttaatgccggcgcggaaggaataaaatagacgttacgcatctgcgcgtagcggtcacccggcaccagtacggtattttcgtcgccgtcgacgaccagcgtttccagtaccagctcaccctcgttgaccaactgatcttttaattgccacagatgctccagcggcgagcgacggtgataaagcacccccattgaaaagacggtatcaaatgctttcagcgccgggagttgttcaatgcccaacggcagcagatgcgcgcgctgatcgttacccaacagtttacgcaccgcctcaaattggcagaggaaaagctgtgtaggatcgatgccgaccgccagatgtgcgcccgcgccaatcatccgccacaggtgatagccgctgccgcagccgacatcaaggatcgtccggccggttaaatctgacagatgcggcagtacgcgatcccacttccagtctgagcgccattcggtatcaatatctacgccataaagcgagaacgggcctttacgccacggcatcagattacgcagcaatgtatcaatacgctttagctgaccttcgctgagcggcgtttcgctttccgccgtgacgctgtgcagtaaatccagccgccagggcgtaatttccggtaaaaattctaccgcgttcgaccactgtttaaacaagccatgctgctgctcgcgttgccaggcggcaatctgcgcgggcaatgtttccagccagtgggagagatgatttttagcaatgagctgataaaagttaccaaactcgatcatgcggcaactccggcttttaacgcgacaagcgacccgaagttaaagcactggaaccacagttcgctgtgttcgaaacccgcctgacgcaggcgcgctttatgtgtttccaccgagtcggtgagcatcacgttttccagcatactgcgcttttggctgatctccagttcgctgtacccattagcgcgtttaaaatcgtggtgcatgttgaataacagctcgcccactttcgcgtcttcaaagctaaatttttccgacagtaccagcgcgccgccgggattcaaccccaggtaaatcttatccagcaatgcctggcgttcggcaggttcaaggaattgtagggtaaaattcagcaccaccatcgaggcgttttcaatagtgatatcgcggatatcgccttcaacgacttcaaccggcgtaggcgctttatacgcatcaatatgacggcggcagcgttcaatcatggccggggagttatcgacggcgataatgcgacaatgctcatggcggatattacgccgaacagacagcgtcgcggcacccagcgagcagcccagatcgtagacctgcgtgttcggctgcacaaagcgttcagctaacatgccgatcatggagatgatgttggagtagcctggtaccgaacgctgaatcatgtcggggaaaacttcggctactcgttcatcaaaagtccagtcgccgagacgggcgataggcgcagaaaaaagcgtgtcgcggtgagacataacgtatacatccgggaaaaataaaggcgcatattgtgcgctaatacagggagaaaaccaactcccagggcatataccacaggtttgccagcaccatcagcaacaatgcgcaccaggtcgcgctcatccccgcccgccgccagcggaacaggcggtggtgaaaaccgtaataatgcatcagccgaccggcgattaaaatgatgccgcagatatgcaccatccacgtttcggcgccgttcatttccataaacagcagcagcaccagcgcgacaggaatatattccaccgcgttgccatgaatacggatggcgctttgcaattcgctaaaaccgccgtcgccataggcgacacggtactgcattcgtaagcgaacgacattaaaagagaacttcattaataataacgcacccaaaacggcatacagcgcgcttaccatacaaactcccttttaaaatggctgatggcactgtctatgatagggggcattttcagaaaagagaagattgctgtggaatggacggagcagtgccgatttccggtaagacgctgcgtaaatcatgccaaagcgtattcaccagttccggcgcctgcgcgatatccggagtatgtaaaaacagaaaaggcgtggtggtctgccgccactgcgggagtttctgcaaccaggcagcgaaaaactcacggttttgcgccatattatcgctaccgataaaacgcaccatcggatggctggccgtcacgaccgcatgtaccgggactttgggtttttttcgctgcgcgtcacggacggcctcgctgtggggatgggcggcatgtaccggacgactatccaggatcacgcggtttacgccgcgcgcgtgtaacccgcgattgagccgctgttcatcctcacccttgtcaaaaaaacacggatgacgaacttctacgccataggtaaacgtggcggggagcgcatcaagaaactgccataaggcggggagatcgcgcggtccaaaggcggcgggcaactgcagccagtattggccaatacgcgtttccagcggcgccaggcgggtaaaaaacgcctgtaccagatcgtcgcaatggcgcagagcggcctggtgagaaatggtggcgggaaatttaaagcaaaaacggaaatcgtccgtagtttgcgcataccagcgatcgacaatttccgctttcggcagcgcgtaaagcgtggtgttgccctccacgcagttaaagtggcgggcatactcttccagactggtgatgccgagccgcgcccatttcgggtgcgaccattgcggcaagccaatgtagatcataaggcgtttaaaatatcctctacgctgcgtacccggccaatgcgcgggaaaatatgcgtcatactgctctgatgctgctcactgctggcggcgctacaggcatcttcggcaataataaggttaaatcccaactcccaggcgttacgcgctgtggattcgacgccgatattggttgagattccgcacaatatgatggtgtcgataccccggcggcgaagctgtaattccaggtcggtgccgtaaaacgcgccccactggcgtttagtcacttccagatcgctgtcctttttacccaatgccgtaggccaggtccaccagttttccggcaacgcgtgcgcaggcgttgcggcatccaccggctgttttaacgcttcggcataatcatcagaccatccaacgcgtaccataaccacgggcgagccgttggcgcgacacttttccgccagccgcgcggcgcgggcgaccacctcatttgccgtatacgggccgccggcaaacggaagaattccttcctgtaaatcaataaccaccagggcggttgtggtcgcgttgagtttcagcatgataatcactctcctaaaaatagcggatttcactacaccttaagcgcgattaaagaggaaagcggcgacaaatattgttaatttttgtgagcatacgcaatacccgcgtgaaaaacccgggtacagtcagtatgaaccaagtgtcgataccgcatgaaacgggcaagttatcgctcccatgctggattgactcttatcgtgcggcagaatttccagtataatagccgccttttttcatccagttgtgacatacagctaaagctgcgacttcgtcgcctgcatggcaggcaacaatccgcctgcggctaagttaagggatatctcatgcgtacagaatattgcggacagctacgtctgtcccacgtggggcagcaggtgactctgtgtggttgggtcaaccgtcgtcgtgatcttggcagcctgatctttatcgatatgcgcgaccgcgaaggtattgtgcaggtgttcttcgatccggatcgtgcggacgcgttaaagctggcctctgaactgcgtaatgagttctgcattcaggttacgggcaccgtgcgtgcgcgtgacgcgaaaaacgtcaatgcggatatggcgaccggcgaaattgaagtgctggcgtcctctctcactatcatcaaccgcgcagactcactgccgcttgacgctaaccacgttaataccgaagaggcgcgtctcaagtaccgctatctggatttgcgtcgtccggaaatggcgcagcgcctgaaaactcgcgccaaaattaccagcctggtgcgtcgttttatggacgatcacggtttccttgatattgaaaccccgatgctgaccaaagcgaccccggaaggcgcgcgcgattacctggtaccgtcccgcgtacacaaaggtaaattctatgcgttgccgcagtcgccgcagctgttcaaacagctcctgatgatgtccggtttcgaccgttactatcagatagtcaaatgcttccgtgatgaagacttacgtgctgaccgtcagccggagtttactcagatcgacgtcgagacctccttcatgaccgcgccacaggtgcgcgaagtgatggaagcgctggtgcgccatttgtggctggaagtgaaaggcgtggatctgggggatttcccggtcatgacgtttgccgaagcggaacgtcgctacggttccgacaagccagacctgcgtaacccgatggagctggtagatgtcgctgacctgctgaaatcggtagagttcgcggtcttcgcgggcccggctaacgatccgaaaggccgcgtggcagcgctgcgtgtgcctggcggcgcacagcttagccgtaagcagatcgacgattacggtaactttgttaagatctacggcgcgaaaggactggcatatatcaaagttaacgagcgcgcgaaaggtctggacgggattaacagtccggtggccaagttcctgaccgccgacatcgtcgaggctatccttgaacgtaccggcgcgcaggacggcgacatgatcttcttcggcgcagataacaaaaaagtggttgccgatgcgctgggcgcgctgcgtctgaaactgggcaaagacctgagcctgaccgacgaagacaaatgggcgccgctgtgggtgattgacttcccgatgttcgaagacgacggcgaaggcggtctgaccgcgatgcaccatccgttcaccgccccgcgtgacatgacggcgtctgaactgaaaactgccccggaagaagccgtcgctaacgcttacgatatggtgattaacggctatgaagtgggtggcggttcggtgcgtattcacaacggtgaaatgcagcaaaccgtatttggtattctcggtatcaatgagcaggagcagcgcgagaagttcggcttcctgttggatgcgttgaaatacggtacgccgccgcacgtgggcctggcgtttggtctggaccgtctgaccatgctgttgaccggcaccgacaatattcgtgatgttatcgccttcccgaaaacgaccgccgccgcgtgtctgatgactgaagcgccgagtttcgccaaccaggcagcgttgacggagttggggattcaggttgtgaagaaagccgagaataactgatatgaacaatgtacacgacatcattcgcgtgatatcgcggcggcccgcaagggggagtctcatcaatgcgcggcgtcacccaacagccaacaacgaggtcgcgtgaaggataaagtgtacaagcgccccgtttcggtcctggtggttattttcgcgcaggatacgaaacgggtgctaatgttgcagcgacgcgacgacccggatttttggcagtcagtgactggcagcatagaagaaggggagaccgcgttgcagaccgccgtgcgtgaagtcaaagaggaggtcacgattgatgttgcggcagagcaactgaccttagtcgactgccaacgtacggtggagtttgaaattttttcacatttacgtcatcgctatgcgccgggcgtcatgcacaatacagaattctggttctgccttgcgttaccgcatgagcggcaggtgatattcactgaacatctaacgtaccagtggcttgatgcgcctgacgcggcggcgcttaccaagtcctggagtaaccggcaagcgattgaagagtttgtcattaacgtcgcctgaaaaggcgcgctttttttgaggaaatatttatggcaggtcatagtaaatgggccaacaccagacatcgtaaagctgcgcaagatgccaagcgcggtaaaatcttcactaaaattattcgtgaactggtaacggcagctaaattgggcggcggcgatccggatgccaacccgcgtctgcgcgcggctgtagataaagcgctggccaacaacatgacccgcgacactctgaaccgtgccatcgctcgcggtgtgggtggtgatgaagactcgaacatggaaaccatcatctatgaaggttatggtcctggcggcacggccattatgattgagtgtttgagtgacaaccgtaaccgtaccgtagcggaagtgcgtcatgctttcagcaagtgcggcggtaatctgggtaccgatggctcagtggcgtacctgttcagtaagaaaggggtcatctcctttgagaaaggcgatgaagacaccatcatggaagccgcactggaagctggcgcggaagatgttgtgacctatgatgatggcgcgattgatgtttacactgcctgggaagagatgggcaaagtgcgtgacgcgctggaagcggcgggtctgaaagcggacagcgccgaagtgtccatgatcccgtcaaccaaagcggatatggatgcggaaaccgcgccgaaactgctacgtcttatcgatatgctggaagactgtgacgatgttcaggaagtctaccataacggtgagatctctgatgaggtggcggcgaccctgtaatggtgctgctaaacgccggcgggcagggggtatagcgtgtcgattattctcggtattgaccccggctcgcgtattaccggttatggcgttatccgccaggtaggcagacaactgacctatctgggcagcggatgtattcgtaccaaagtcgatgatttgccgtctcgtttgaagctcatatacgcaggcgtgacggaaatcatcacgcagttccagccggactattttgctatcgaacaagtgtttatggcgaagaatgccgattcagccctcaagctgggacaggcgcgcggcgtagcgattgtcgccgcggtcaaccaggaactgcccgtgtttgaatacgcggcgcgtcaggtgaagcaaactgtcgtcggtattggtagcgcggagaaaagccaggtacagcatatggttcgtacgttgctgaagctccccgctaacccgcaggcagacgccgcagatgcgctggctatcgccattacgcattgccatgttagccagaacgcgatgcaaatgagcgagagccgactcaatctggcgcggggaaggttgcgctaaattattctccctcagcctcgcgttgagggttttcaattccacaggcgctaattaattctaaattgggatgttgccacaggctggcgggcgtcaccgtcttacgatcccacgggattgaacctaaaaaccagaatttccagaaggtgagtttcgcatcaggattgctgtgaagtaattcttcgaatgtctcaatatcgcctaccggaatacacaatgcttctttatagatatcaaacacaaatttcgagcagaactggcgcgatgactcgtatttaaaccccgtgtgataaaacttattcagccgggcgggaacctgctccatgatggcgagtttctgctcgaccgtcaggccgccgcacaggcgacgaaccgcgtaacgttgtccggctgaacgttgtataaacagtgacagcgtggtgacggttgagagggggacgcgactttccgccaccagatagtcatcaccattatgaccaataataatcccaacatggttgctccagcactgtgaagcggtggatatctggccgaaaagcgcggcacctatacaggtaaagacgatatccccggtttcatattggacaggataatgttttttcatctctgcattccattatttgaaataaattccttttatttattctacagggtagttagcattataccagataaatgacaagccttagtgtcatcgaaatatgtatggtgaatatttcatttgttggaattaatgtcgcaaatataactggggaggaattaaggtggtaaatttctcattatctgctctcttatattgacagggagtacgacgtggttgatgataaaccaatgaaaataggttgggtgttttatttttcttatatttttgttgctattatctttcatctgtttattagtttttgttattgtttgagtattgatatggcagaggctaataccgttgtttttttattaaagccagggacgatttcattattatttttacttctccctgccaggcggttcagaaccagactgttggcaacattgagttcagttttcattgccttagtatttaaccagtggcatttggttgccgggaataaagaactggttttgtgcatgcaggcagcgtgctttatggctttcctggctatgacatcggtaaaaaaatccgggtggatgattagcgcatcattatttttggtttgtgcggccggaacgattcgccagtgctggctggaacagttgtttaacgctgccgatatatatattgttgatgatgggcggagctgtggtgccagcggccactgcttccagtatattgcagcaaaaggccgtgggttagcagcaaaacgacaggcactttttagtagtgaagagtatgtgaatatttattatagttattcagaagggataccagccgtgaatttcgatggcatgaaaaatgagtttgcacaatatttattgtgtcatggtgaattaaaatatgttgtgcgcgacgataaaacaacatgcgattaaattcagcgctagtggttaattttattaaatctattctcgggtctgttttttggggggaccgatgttccgctgttggcattcgtactggatacagtattagtgttatcaggatactcattattgaagactaccaaacttgcgccacggcatgttggcaaaaagttattcgcgtaggacgcaaaaagttgtcaatgagtgtacgacttattttgtacgcagcggggagcgtgcccgtcgttaactatcgcgggttgtcggagtacagaaatatcgggataagtgtttttcatctggataaacatccagtctttttttatgatagtgcattatcttttcagccctttacgcaggagcgtcatgtgataggcagactcagaggcattattctcgaaaaacaacccccgatcgtgctgctggagacagggggcgtaggctatgaagtacatatgcctatgacctgcttttacgagctgccggaggccgggcaggaggcaatcgtcttcacccacttcgtggtgcgtgaagatgcgcagttgctgtacggatttaacaataagcaagagcgcacgctatttaaagagctaattaaaacgaatggcgtcgggcctaagctggcgctggcgatcctctccggcatgtcggcgcagcagtttgtgaatgcggttgagcgcgaagagctgggtgcgctggtgaagctgccgggtatcggcaagaaaaccgccgaaaggctgattgtcgaaatgaaagaccgctttaaagggctacatggcgatctctttacgccagcggtcgatctggtattgacgtcgccggccagcccaacctcggaagatgcagaacaagaagcagttgctgcgctggtggcgctgggttataaaccgcaagaagccagtcggatggtaagtaagatcgcccgtccggacgcaagcagtgaaacactgattcgcgacgcgttacgcgccgcgctatgaggtaaaggatgatagaagcagatcgcctgatttcagcaggcgccacgatcgcagaagacgtcgccgatcgcgccattcgcccgaagttattggcggaatatgtcggccaaccgcaggtgcgctcccagatggagatctttattcaggcggcaaaacggcgtggcgacgcattagatcacttgctgattttcggcccgccagggttaggtaaaacgactctggcgaatatcgttgccaatgaaatgggcgtcaacctccgaaccacgtccggcccggtgctggaaaaagcaggcgatctggcggctatgctcaccaatcttgaaccgcatgatgtgctgtttattgatgagatccaccggctttcaccggtggtggaagaggtactctatccggcgatggaagattaccagttggatattatgattggcgaagggccggctgcacgttcaattaaaatcgatctgccgccgtttacgctcattggcgcgacgacgcgcgccgggtcgttaacgtccccgctacgtgaccgttttggtattgtgcagcgcctggagttctaccaggtgcccgatctgcagcacatcgtcgggcgcagcgcaaggcacatggggcttgagatgagcgatgacggcgcgctggaagtggcgcgtcgggcgcgcggtacgccgcgtatagccaaccgcctgctcagacgtgtgcgtgattttgctgaggtgaagcatgacggggctatttcagcggaaattgccgcgcaggcgctggatatgctgaacgtcgatgcggaagggtttgattatatggatcgcaagctactgctggcggttattgataaattcttcggtggcccggtgggactggataatctggcggcggcgattggcgaagagcgtgaaaccattgaggatgtgctggagccgtatctgattcagcaaggctttttgcagcgcacgccgcgtgggcgtatggcaacggtgcgcgcctggaaccactttggtattacgccgccagagatgccttaacgcctgaagtcgctgcgctcatcaggcctgggcgattttgtaggcccggtaagcgcagcgccaccgggcaacacacgcttagcttgcctgctttttcatcatactgaagataaacagcagcgcggcacacagcactacggatggccctgccggggtatcataaaaggctgagaaggtcagtccacctgtaaccgctatcatacctacaccaacggcgacgcccgccatctgctccggcgtacgggcaaagcgacgcgcggttgcggcggggataatcagcagcgaggtgataatcagcgctccgacaaacttcatcgttacgccaatggttaacgccgttaccagcatcaatagcagcttcacgcgctgtaacttcacgccatcgacaaaggcaagatccggactgatagtcattgacagcaagttgcgccactgccagaagagaatggccagcacaataacgaccccaatagcgatcgagataagatcttccggcgtcacggccagcaaatcgccaaacagataagccattaaatcaacgcggacgttggacatcaggctgaccacgaccagtcctaaagacaaggcgctgtgtgccataatgcccagtaaggtatcaatcgcgaggtgagggcgtttctccagccataccagaccggaggccagcagcagcgtaacggcgattaccgcataaaaggggttaacgtccagcaacaggccaaacgccacgcccagaagcgacgcgtgagccagcgtatcgccaaaataggacatccgacgccagaccacaaatgagcccaacggaccagcagcgcaggccagcatcatcccggccagccagccgggcagtaataattcaatcatgagtgaccatttccccggcgcagtacaatacgaccctgtaaatcgtggcgatgattatgatgatggcgataaatccctaattgctccgcgccacgcgggccaaacatagagataaattccggatgcatagacaccacttccggcgcgccggaacagcaaatatgatggttcaggcataacacttcatccgtttttgccatgaccagatgtagatcatgcgacaccatcagaacggcgcaatcgagttcacggcgcagctgatcgataaggtcgtataacgcgacctggccgttgacatccacgccttgcgtcggctcatcaagtaccagcaactgcggcctgttaagcagagcacgggccagcagtacgcgctgtgtctcaccgccggagagtttttgcatgggcgcgtcaatcaaatgtccggcctgaacgcgtttaagcgccgggagaatatccgttttttgcgtgcagggacgtaaacgtaaaaatcggtttaccgtcagcggaagcgtggtatcgagatagagcttttgcgggacatagccgatacggagttgcccgttgcgcttgatcaccccttcatcaggggctaccagtcctaaaaccacgcgtacaagcgttgacttccccgcaccgttagggccgagaagcgttaaaatttttccggggctcaattcaagcgacacgtcagagaggacgcggcgttgaccaaatgagaccgagacgttttccagtgaaactaaacttgtcatgttaattttaggcttgcagaagtgatagaatgttataatatcacatttcacatattcattacgatgattagtcgcattatgttacagaaaaatacgcttcttttcgcagcattatccgccgcgctttgggggagtgcaacccaggctgccgacgccgccgttgtcgcttcgcttaaaccgcttgggtttattgcttccgccattgctgatggcgttacggatacgcaagtattacttccggatggggcatccgagcatgattattcattgcgtccatcagacgtaaaacgcttacagggcgcggacttagtcgtctgggttggcccggaaatggaagcctttatggagaagtcggtcaggaatatccctgataataagcaggttaccattgcgcaacttgccgatgtaaaaccgttactcatgaagggcgcggatgatgatgaggatgaacatgcgcatacgggcgccgatgaggaaaaaggtgacgtacatcaccatcacggcgaatataacatgcatctttggctctccccagagatagcgcgggctacagcggttgcaatccatgaaaaattagtggaacttatgccgcaaagtcgagctaaactcgacgccaacctgaaggattttgaggcacaattagccgcaaccgataaacaggtcggtaacgagctcgcgccgctcaaggggaaagggtatttcgtttttcatgacgcctacggttactacgaaaaacactacggactcaccccactcggtcactttaccgtgaaccctgagatacaacctggcgcgcagcgtttacatgaaataagaacacagttggttgagcaaaaagcaacctgcgtttttgctgagccacaattcaggccagcggtcgtggaagccgtggcgagagggacatccgttcgaatgggaacactggaccccctcgggacgaacattaaactgggtaaaacaagctattcagcgtttttaagccaattagccaaccagtatgcgagctgcctgaaaggagattaacgaggaagtgaatacgtgcaacagatagccggctctgtcgccctggcatttaataatctgccccgaccccaccgcgttatgctggggtcacttaccgttctgacactggccgtcgccgtatggcggccctatgtttaccacccagaatccgcaccaatcgttaaaactattgaactggagaaaagcgagattcgttccctcttaccggaggccagcgaacccatcgatcaggccgcgcaggaagatgaagctattcctcaggatgagctggacgataaaaccgcaggcgaagtcggcgtccatgaatacgtcgtctccacaggcgatacgttaagcagtattctgaatcagtacggcatcgatatgagcgatattagccgacttgccgcttctgataaggagctgcgcaatctgaaaattggccaacagctttcctggacactgaccgccgatggcgatttacagcgtctgacatgggaagtctcccgccgtgaaacgcgtacctacgatcgcactgccaacggttttaaaatgagcagtgaaatgcagcagggggactgggtcaacagtctgctgaaaggcacggtagggggcagctttgtcgccagcgcgaaagaggctggtttaaccagcagcgaaatcagcgcagtgataaaagcaatgcagtggcagatggattttcggaagctgaaaaagggcgatgaattttcggttctgatgtcgcgtgagatgctggatggcaagcgtgaacagagtcagttgttgggcgtgcgtatgcgttccgatggtaaagattactacgccattcgcgccgctgacggtaaattctatgaccgtaacggtgttggcctggcgaaaggctttttacgcttcccgaccgccaaacagttccgcatctcctccaacttcaatccgcgtcgtctgaacccggttaccggacgcgttgcgccgcatcgtggcgttgactttgcgatgccgcagggtacgccggtgctgtcggtgggggatggcgaggtcgtggttgctaaacgtagcggcgctgccggttactacattgcgattcgtcatggacgcacctacaccacacgttacatgcacttgcgtaagctgctggtgaaaccggggcaaaaagtgaaacgtggcgatcgtattgcgctttctggtaacaccgggcgttccacagggccgcatctgcattatgaggtatggatcaaccagcaagccgttaaccctctgacagcaaaattgccgcgcacggaaggtctgacggggtcagatcgtcgtgaatacctggcacaggtgaaagagattctgccgcaactgcgcttcgattaacaaatgcgttgacagagccggtacgcgatgtgtgccggctgttttgttttgtgtgcggcgcagacatcgctacactattcacaattccttttcgcgtcagcagaccctggaaaagcatggaaaccaaaaaaaataatagtgagtatatccctgaattcgaaaaatcctttcgctatccgcagtattggggcgcctggttgggcgctgcggcaatggcggggatcgcattaacgccggcatcattccgcgaccctttgctggcgacgctggggcgttttgccggacggctggggaagagttctcgtcgccgggcgctaattaatctgtcattgtgctttccgcagcgtagcgaagctgaacgcgaagcgattgtcgatgagatgttcgccaccgcgccgcaggcaatggcgatgatggctgagctggcgatgcgcggtccgaaaaaaattcaacagcgtgttgactgggaaggtctggagattatcgaggagatgcgtcgtaacgacgaaaaagttatttttctcgtaccgcatggctggggcgtcgacattccagccatgctgatggcctctcaggggcaaaaaatggcggcgatgtttcataatcagggtaatccggtttttgactatatctggaataccgtgcgtcggcgttttggcggacgtttgcatgcgcgcaatgacgggattaaaccctttattcagtctgttcgtcagggctactggggttactacctgccggaccaggatcatggcccggagcatagtgaattcgttgatttctttgcgacatacaaagcaacgctgcctgcaattggtcggctgatgaaagtgtgccgcgcacgcgtgataccgcttttcccggtgtataatggtaaaacgcatcgcctgactatccagattcgtccgccaatggacgatctgctcacggctgacgaccacactatcgccagacggatgaacgaagaggtcgaaatttttgtcggcccgcatccggaacagtacacctggattctgaagttgctcaaaacccgcaagccaggcgagattcagccgtataagcgtaaagatctttatcccatcaaataaataaagcctctcgtaagagaggctttatgctgacaaaccctgtattacctgatgagcaggccagggggagctttactcaacggtcaaaatacgcgtggtattggttgaaccgacggtgctcatgacatcgccctgggtcacgataaccaggtcaccggaaaccagataccctttatcgcgcagcagattaacagcttcatgcgccgcgacaacgccatcagccgcgctatcaaaatgcaccggcgttactccgcggtagagcgcggtcaggttcagcgtgcgttcatggcgcgacatggcgaaaatcggcaggccggagctgatacgggaagtcattagcgcggtacgaccggattccgtcatggtgatgatcgcggtaacgcctttcagatggtttgccgcatacatcgcagacatggcaatggcttcttcaacattgtcgaactgcacgtcgagacggtgtttagacacattgatgctggggattttttctgcgcccagacagacgcgcgccattgcggcaacggtttcagaaggatactgaccggctgcggtttcggcagacagcataactgcatccgtgccatccaggacggcgttcgccacgtccatcacttccgcacgggtcggcatcgggttggtgatcatcgactccatcatctgcgttgcggtgatgactgcgcggtttagctgacgcgcacggcgaatcagcgccttctggataccaaccagctccggatcgccgatttcaacgcccaggttgccacgtgcgaccatcacaacgtcagaggccagaatgatatcgtccatagcgttttgatcgcataccgcttcggcgcgttcgactttagccacaattttcgcgtcacagccggcgtcgcgcgccaggcggcgtgcatagttcagatcttcgccgcagcgcgggaaggagactgccagatagtcaacgcctatcagcgcagcggtttgaatatcggctttatctttttcggtcagcgcttcagcagaaagcccgccgccgagcttgttaatgcctttattgttagacagcgggccgccgacggtgacctcggtaaagactttcatgccctggacttcaagcactttcaactgcactcgaccatcgtcaagcagcaggatatcgccaggaacgacgtctgccggcaaccctttgtaatcaatgccgactttttctttatcgccttcgcctttacccaggttagcgtctaacagaaatttgtccccgatattgaggaacactttgccttctttaaaagtggaaacgcgaatttttggcccttgcaggtcgcctaaaatagccacatgacgccccaatttggcggcaatctcacggactttatcagcacgcattttatgatcttccggcgagccgtgagagaagttcatacgtactacgtttgcgcccgcggcgataaccttctcaaggttgttatcgcggtcagttgccgggcctaacgtggtaacgattttggttctgcgaagccttctggacatgtaatactccgttgactaaaacaacttggtgttgcgtgaacattgatccggtcgttctgaaaccttaacggtataaaatgaacgtccccggatgacgaaaagggtagaacattgttattgcttttagcggtcatcactcctgatgagtaattctttatcaaaacgcgattccttgagcgcttccttgacacgcttcaagttatctctgaattttgccccgcgacgcaaagtaaatcccgttgccagcacatctatcacggtcagttgagcaagtcgagagaccatgggcatataaatgtctgtatcttccggtacgtcgagggtaatggccagcgtggcttcgcgcgccagcggcgttccagcggaggtcagggcgatcaccatcgcatcgttttcccgcgccaactgcgccagttccaccaggctcttggttctgccagtatgcgaaatgagcacgacgacgtcatcatcgttacaattcatacagctcatccgttgcagcacgatatcgtcggagtaaatcaccggcacattgaagcgaaaaaacttattcatggcgtcatgcgcgaccgcggcggaggaaccaagaccaaaaaaggcgattttttttgcctgggtcagtaaatcgacggcgcggttgacggccgatttatccagcgactgacgaacatggtcgagactggccatggcggactcgaagatttttcctgtataggcctcaacgctgtcatcttcatccacattgcgattaacatagggggtgccatttgccagactttgcgccagatgcagtttaaaatcaggaaagccgcgggtattcatgctgcgacagaaacggttcaccgttggctcgctaacgttagcttcctgggccagcatggcaatgcttaagtgaatcgatctgcctggggcggccagaataacatcggcgacttttcgttcagatttgcttaaatgttccagttgagactggactttttccagcatattcatgattagcaaggctcatgggtattagcgatttcaatgatgcgcgaaaccgagcgcgttttgttagatattactcctggcggctgtcaaagggggcaaaatggctaaaaaaggtgtcgttttttttcattacatgaccgacgtcggattttaagttccagcttgtgtggaaaagcgacaattttattaggcgttttgccgattatattgccaatcaaacgccggttcacctatgaaaaggcgtttacggtttccgtaatctcgtaaaagcagtacagtgctgtgtaataaaattacaacgatatcctggctaaagtaccaggagattaactgaggagaatgacatggcggtaacgcaaacagcccaggcatgtgacctggtcattttcggcgcgaaaggcgacctggcgcgccggaaactgctgccttccctgtatcagcttgagaaagccggccagatccatccggatacccggatcattggggtggggcgcgcggactgggataaagaagcttatacccacgttgtgcgtgaggcgctggaaaccttcatgaaggaaaaaattgatgaaggcttgtgggatacgctgagcggccgtctggatttttgtaatcttgacgttaacgatacgcctgcgttcagtcgcctgggcgatatgctggatcaaaaaaaccgcaccaccattaactattttgcgatgccgcccagcacgtttggcgctatttgcaaagggttaggggaggctaaactcaacgccaaaccggcgcgtgtcgtgatggagaaaccgttgggtacttcgctggcgacctcgcgtgagattaacgatcgggtcggcgaatactttgaagagtgccaagtatatcgtatcgaccactatctgggcaaagaaacggttctcaacctgctggcgctgcgttttgccaactcgttattcgttaataactgggataaccgcactatcgatcacgttgagattaccgtagcggaagaggtggggattgaagggcgctggggatattttgaccaggccggtcagatgcgcgatatgatccagaaccacttgctgcaaattctctgcatgattgccatgtcaccgccgtctgacctgagcgccgacagtattcgcgatgaaaaagtaaaagtgttgaaatcgttgcgccgtattgatcgctccaacgtgcgtgaaaaaacggttcgtggtcaatacaccgcgggctttgcgcagggtcaaaaggtgccgggctatctggaagaagagggcgcgaataaaagcagcaacaccgaaactttcgtcgcgatccgcgtcgacatcgataactggcgttgggcgggcgtgccattctatctgcgcaccggcaagcgtctgccaactaagtgctctgaagtcgtggtttatttcaagacgcctgaactgaatctctttaaagagtcctggcaagacctgccgcagaacaaattgacgattcgcctgcagccggatgaaggcgtagatattcaggtacttaacaaagtaccgaggctggatcataagcataatctgcaaatcacgaagcttgatctgagctactccgagacctttaatcagacgcacctggcggatgcatatgagcgcctgctgctggaaacgatgcgtggcattcaggcgctgtttgtccgccgtgacgaagtggaagaagcctggaagtgggtggactccattaccgaagcatgggcgatggacaacgacgcgccgaagccgtatcaggcgggcacctggggaccggtagcgtccgtggcgatgattacccgtgacggtcgttcgtggaatgagtttgagtaaatttgccactcactcttaggtggtattttaccggtaacatgatctaacacagattgtagaatcatttttgcacttttaagcctcgtgtggattcacctgcgaggctttttttattacactgcctgaaacgattttgccccattatccccggacatcatgtatttcactgtctttccacattgatgaaacgcatggtaaacccggtagccggacagataaatttcaggagcctctatgaatcctaatttgttacgcgtaacacagcgcattgtcgaacgctcgcagcagacccgaaaagcctatcttgcccgcattgagcaggcgaaaaccgccacggtccaccgatctcaactggcctgcggcaacctggcgcatggcttcgccgcctgtcagccagaggacaaagcctcgctgaaaagtatgttgcgcaataatatcgccatcattacctcctacaatgacatgctctctgcgcatcaaccgtatgaacattatccgcagattattcgtcaggccctgcattccgtgaatgcggtaggtcaggtcgcaggcggcgtaccggcaatgtgcgatggcgttacgcaagggcaggatggcatggagttgtcattactcagccgcgaagtgatagcgatgtcggcagcagtaggcctttctcacaatatgtttgacggcgcgttattcctcggcgtatgcgacaaaattgttccggggctggcgatggccgcgctctcttttggtcatttacccgcgatttttgttccgtcaggcccgatggcgagcggcctgccgaataaagaaaaagtccgtattcgtcagctatatgcggaaggaaaagtagacagaatggcgctgctggagtcggaagccgcctcttaccatgcgccgggcacctgtacattttacggcactgccaacaccaaccagatggtggtggagtttatgggaatgcagttgccgggttcctcgtttgtgcatccggatgcgccgctgcgcgaggcattgactgccgctgccgcacgtcaggtaacacgtcttaccggcaacggcaatacgtggatgccgctcggtaaaatgatcgacgaaaaagtcgtggtgaacggcattgtcgcgctgctggctaccggcggttccaccaaccacaccatgcatctggttgcaatggcgcgcgcggcgggcattctgatcaactgggatgacttctcggatttgtcggaagtggttccgttgatggcgcgtctgtacccgaacggtccggcggacattaaccacttccaggcggcgggcggcgtaccggtattgatgcgtgagctgctcaatgccggattgctgcacgaagacgttaatactgtcgcaggcttcggcctgaaacgctatacgctggagccctggctcaacaacggcgagctggactggcgtgaaggcgcggaaaggtcactggataacgatgtcattgcctcttttgataagccgttctctcctcacggcggtactaaggtgctaagcggtaatctggggcgcgcagtaatgaagacgtctgcggtaccggttgaaaaccagatcattgaagcgcctgccatggtatttgaaagtcagcatgatgtgctgcctgcgtttgacgcgggcctgcttgaccgggattgtgtcgttgtcgtgcgtcatcagggaccaaaagcgaatggaatgccagaattacataaactcatgccgccacttggtgtattattggaccgccgtttcaaaatcgcgttagttactgatggacgactttcaggcgcttcgggtaaagtgccttcagctatccacgtaacgccggaagcctacgatggcggcttactggcaaaagtgcgcgatggcgacatcattcgcgtgaatgggcagacaggtgagttaactctgctggtcgacgaggcggaacttgccgctcgtcagcctcatattccggacctgagcgcgtcgcgcgtcggaacggggcgtgagttgtttggcgcgctgcgcgaaaagctgtcgggtgcggagcagggcgcaacctgtatcactttttaagatgacacactagtaatcaggcgagagaagaattccgatgaaaaactggaaaacaagtgcagaagcaatcctgaccaccggcccggttgtcccggtcattgtagtcaataaactggagcacgcggtgccgatggctaaagcgctggtggccgggggcgttcgcgttctggaagtgactttacgtacggcctgcgcgatggatgctattcgcgctatcgctaaagacgtgccggaagcgattgtcggcgccggaaccgttctcaatccgcagcagttggcggaggtgacggaggcgggcgcgcagtttgcgattagcccgggactgactgagccactgctgaaagccgcgacggcaggcactatcccattgattcccggtattagcaccgtttctgaactgatgttgggcatggactatggtctgaaagagttcaaattcttcccggcggaagcgaatggcggcactaaagcgttgcaggcgattgccggtccgttctctcaggtacgtttctgcccaaccggcggcatctctctggcaaactatcgtgactatctggcgctgaaaagcgtgttgtgcatcggcggttcctggctggtgccggccgacgcgctggaagcgggtgattacgatcgcatcaccaaactggcgcgcgaagcggtagaaggcgcgaagcagtaagccgttaaatgcccgatggcgcttgcttatcgggcttacgagtggcgatcaggcaggcctgataaaaatgtgctaacgtcgccatcaggcgatggcgcattagccttttaccgtcacgcggctggcggcctttttcgctcttatcaccgcttcttcaacgttttcacctgtcgctaacgctacaccaagacgacgggtgccgtcgatctcaggcttaccaaacagccgtacctgcactccggcccctaccgccgcgtgtacatcatcaaacgtcacattttgactggtaagctgcggcagaatcacggccgaggcagcgggaccatactggcgaatagcgcctatgggcattcccagaaaggcgcgcacatgcagcgcaaactcagaaagatcctgagaaatcaacgtgaccattccggtatcgtgcgggcgaggggagacttcgctgaaaatgacttcatcgccacagacgaagagttcaacgccgaacagaccatgaccgcctaacgccagtaccacatgacgagcaatctcttgcgcccgcttcagcgccagttcgctcatctgctgtggttgccaggattcgcgatagtcaccatcttgctgacgatgaccgaccggcgcgcagaaatgcacgccatcgacggcgctaacggtgagcagcgtaatttcaaaatcaaatttaaccacgccttccacaatcacgcgacccgcgccagcgcgtccgccctgttgagcatactcccatgcctgcgcgagctgttcggccgagcggataaagctctggcctttgccggaagagctcatgaccggtttgacgatgcaaggaaaacccactgcggctaccgcatcatgaaaactggcctcactgtcggcaaagcgatacgtcgatgtcggcagacctaattcttctgcggccaggcgacggatcccttcgcggttcatcgtgagctgcgttgcacgggcgcaaggcacgacattcagcccttcgccctccagctcgcgcagcgtatcggtggcgatcgcttctatttccggcacgatataatgcggtttttcctctgtaatcacatgacgtagcgcctcgccgtccagcatattaatgacgtgtgaacggtgagccacatgcatggcgggagcatcaggatagcgatcgacggcgataacctcgatccccaggcgttggcattcaatcgccacctcttttcccaattcacctgcccctaataacatcacccgcgttgctgccggacgtagcgcagtgcctaatagcgtcatatttctgtccccttatttacctgcgcgcagtatatacgaaaacgtttgcgtatgtcttttcgaataaattgcttttcttgccgccttgcaatatactgtatataaacacaggtaaataaggggctgcaaaatggcggttgaagttaaatacgtagtcattcgcgagggtgaggagaagatgtcatttaccagtaaaaaggaagccgacgcctgggacaaaatgctcgatactgccgatcttcttgatacctggcttgagcagtcgccagtcgtgctggaagatgggcagcgcgaggcgttgtcgctgtggatggcggaacataaagaggtgttaagcacgatcctcaaaaccggtaagttgccttctccgcaggcggttgaaaaggacgccgcgagtaaaacgaaaaagcaagccgcctgaacccacacttgcgctctcggcgttttgtaccatgcttttcctgaatcattgtgctaaggagaaaagtatgaataaaagaggagcgttgttgagcctgctgttgttatccgccagcgtatcggcatttgcggcatccaccgagagtaaatcggttaagtttccgcagtgcgaagggctggatgccgccgggattgcggcaagcgtgaagcgcgactaccagcaaaatcgtatcgtgcggtgggcagacgaccaaaaaaaggtcgggcaggctgacccggtcgcgtgggttaatgtgcaggacgttgtgggtcaaaatgataaatggaccgttccgctaaccgttcgcggtaaaagcgccgatatccattatcaggtcatcgttgattgcaaagccggcaaggcggaatataagccccgctagcagcgtaatttgcgcttcttttgccggaacagacaattcctgacatcccctcaggtacgcttgaccattattggtctgtatttgaggggtactatggctaactggttgaaccaattacaatcacttcttgggcaaaaaggcgcttctgcatcgccttccggtgaacaggggttaaataaactgctggttcccggcgcgctgggcggtctggctggactgttggtcgccaataagtcttcgcgcaaattattaaccaaatacggtactggcgctttgctggtgggcggcggcgcggtggcgagttccgtattgtggaataagtacaaagataaagtacgcgctgcgcatcagggggagccgcaattcggcagccaaagtacgccgctggatattcgcactgagcgactgatcctagcgctggtttttgctgcaaaaagcgatgggcatattgatgccaaagaacgcgcggcgattgagcaccaactgcgagaatcaggtgtggaagagcaagggcgtgtgtttatcgagaaagctattgagcagccgcttgatccacaacgtctggcacagggcgttcgcaatgaagaagaagccctggaaatctacttcctgagctgcgccgccattgatattgaccactttatggaacgtagctatctgaatgcgttaggagacgcgctaaaaattcctcaggaggttcgggacggtatcgagcaggacttgcagcagcaaaaacaggcgctaccaggctgataacctgccattaagtaacatgtttcgcttgcatcatgcgtgtcttttgccacccttataggatggatagtttacgtcattcatgttgcaagatagcggcgaagcagtgacatctcaggcgcttaccgaggtgagcggaccgggactaccatgctaagccgctgtgtttgccgcgtgatatataacaaatattaacgcaaaagaaaaaacgacatgttgccaaaagccaatcgaattccctatgccatgaccgtacatggcgatacgcgcattgataattattactggctgcgagatgacactcgctcgcagccggaagtccttgattacctgcatcaggaaaatgagtatggccggaaggtcatgtcctctcagcaggcgttacaggaccgcattctaaaagaaattatcgatcgcatcccgcccagagaagtttccgctccgtatgtgaaaaacggctatcgctaccgttatatctatgaacccggctgcgaatatgccatctatcaacgacaatcggcgttaagcgaagagtggaatgtgtgggaaaccttgctcgatgcgaaccagcgggccgcgcacagcgaattttatacgctcggcgggcttgccattacgccggataataccatcatggcgctggcagaagattatttatcccgtcgtcagtatgggttgcgttttcgtaacctcgaaagcggtaactggtatccggaactgctggataacgttgcgcctgaatttgtctgggccaatgattccctgactctttactatgtgcgtaagcataagaagacgctgctgccctatcaggtttggcggcacacgattggcactccgtcatcgcaagatgaactggtatatgaggagaaagacgataccttttatgtcagcctgcataaaaccacttcgcagcattatgtggtgattcatcttgccagcgccaccactagcgaagtgctattacttgacgcggaactggccgatgccgagccgttttcattcttaccgcgccgcaaagaccatgaatatagtctcgatcactatcaacataagttttacctgcgctctaaccggaacggtaaaaactttgggttgtaccgtacccgcgtgcgcaatgaaaacgcctgggaagagctgatccctccgcgcgagcatattatgctggaagggtttaccctgtttaccgactggttagtggtcgaagagcgtcaacgggggcttaccagcctgcggcaaattaaccgtaaaacccgtgaagtgataggcattgcctttgacgatccggcttacgtgacgtggcttgcctataatcccgaacctgagacctcccggctgcgttacggctattcttcaatgacgacgccagataccttgtttgaactggatatggataccggagaacgacgggtacttaaacagacggaagtgcctgggtttgattctggctgttatcagagcgaacacctgtggatcaccgcacgcgacggcgtcgaagtgccggtatcgctggtttatcatcagaagtattttcgtaaagggcaaaatccgcttctggtttacggttacggatcttacggttccagtattgacgccgacttcagcagcagccgactgagcttgctggatcgtggctttgtttacgcaatcgtacacgttcgcggcggcggtgagctggggcagcagtggtatgaagatggcaaattcctcaaaaagcggaatacttttaatgactatcttgatgcctgcgatgccttattaaaactgggttacggttcaccgtcgctgtgttatgggatgggcgggagcgcgggcggaatgctaatgggcgtcgctatcaacgaacgccccgagcttttccacggcgttattgcccaggtgccctttgttgatgtattaaccacgatgctggatgagtcgatcccattaacgacaggggagtttgaagagtgggggaacccgcaggatattgagtattatgactatatgaaaagctatagtccttatgacaatgtcaaagcgcaggactatccgcacctgctggtgacgacaggattgcacgattcccaggtgcaatactgggaaccggcgaagtgggtggcaaaattacgcgagctaaaaacggaccaacgtctgctgctgttatgtacggatatggactccgggcacggtggtaagtcggggcggtttaaatcctacgaaggcgtcgcgctggagttcgcctttttaatcggcctggcgcagggaaccttacatagcgcatagacgcgcgcgcccgcaacggcttgtgagcgtcgcgggttattgtggtgttccattgctgcgttgctcgccagcctgaacatcttccaggtagtgtttaagcgtcaggcgaagttccgggctcatattatcaaggttattaaaaagccagcgtaaatagcccggatcgcgttttgcgacttcagataccgccttaccgcggtatttaccgaacgggaaagtggttaacagcgcaggacggcccgtgatattgaccatctcttccgcggtccagccggtggttcgcataatatcaatcagcaaggcggcggtgatatagcaatcataaagcgcccggtgatggtgcagccccggcggcgtttgtacgcttagtttgcgcgatttatagagcgccatattgctgtattttattcccggccacaggcgtcgcgacaacttcatggtacagatccactcacccggcaattcaggtaatacgcgtctgtcgaaactggcattgtgagcgacataccactcactaccgtaataaagcggtatgacatcttcaatccacggcttatcggcgaccatggcttcggtaatacggtgtatcgccatcgcctgcggcgtaatagggcgatcggggcgtatcaggtgactcatgggattgacaatgttgccatcaatgacatctacagaggctatctctacgatcccgccctgcagcccgcaggtttccgtgtctataatccgcaacatgattcattcctcacccaaagaccttagcgtaatggaatgatatcgccttgccaaccctcggttgtgcgcagacccgtcagtaatagcgaaccgcaatcggcacgaacaataagttgcccgctttcatcccacagcgcgctactgccacaggcattggccatcagtacggccagcgcatatttatgcgaaaaacgttgtaagcgtgaggtagaagcatggagttcaggctcgttaagacattgactggttgtgaataacgtaaatgaggggcctatatcaccaccttctggctgctcatccaccacgttgatagcgcttcgctgcctggcaatacaggcgccatgacttttgtgaaacatgagcggcgacgttagccatggggcaaaaatagcgatgccttttacgaagcggcagttatgctcaacaggcatacccacaatgatagtcatatggtgggtatcggccgcatgagtgagcggctgtaaaagcgcctcgtcaggcggggcgggcaacggtttatttctttcgtcgcagcctaatagcgacagtgacggaaagaccagcagttcgcactgttgacgagccgcaagctcaatatattccagatgatgggcgacatgctctgccggcgaagcgttcaggggcgcgtactgcgcagcggcaattttccaggaggacataatgacttccttttcatagtctctacagccattctaaaaagcataggttaagaatcgccttataatgtagtcgtctgcatgtaaggaagtgtaacgttatataatttttatttaactttgggttcgtaagggagtcgggatagtgatacggaagccagacgatgggcaatcagccgctcgcgaaaccaggcgcgtagatgctctggctgctcacgttcgaccgcctccgcgacaactggcatattgtagcgctctttaaatgccaccccagctgccgccagatccacattgactttatccatttccgcttgttcaagctgagccagattcgttttcatacgtgtctccttttttgttgccgccagaaggtactaagagtccgcggcaatggcaagatggaaatgatgatcctcgactcattgattgttgaaggttattctttgtaacgtaggtataacaaaaaggaatagtgaatatggcttcttctgcaccatcgcgacgtttagctttactgctgctggcatcgacatttgcgacgccagcggcctgggcacatgcgcacctgacgcatcagtatccagcagcgaatgctgccgttacggcctcgccacaggcgctgactctgaacttttttgaagggattgagccaggattcagcggcgcaaccattactggccctcagcaagagtccatcaaaacgcgcccggcaaagcgaaatgaacaggataaaacgcagttgattatcccgcttgagcagccgttaaaatctggcgcttacacggtagactggcacgttgtgtcggtggatggacataaaacaaaagggaaatacaccttcagcgtgaaataaatgatgctgacattcgtctggataactctccgatttattcattttgctagtttgatgctggtctacggctgcgcgctttacggcgcctggctggcacccgcatcaattcgtcgtttaatgacgcgtcgatttttacatctgcaacgacatgccgccgcctggagcgttatcagcgcggcttttatgctggcaattcagggcggactgatgggcggcggctggcccgatgttttttccgtctcggtttggggcgcggtactgcaaacccgctttggcgcggtctggatatggcaaattatcctcgcgctggtcacgctggcggtggtagtcattgcgccggtaaaaatgcaacgacggcttcttattctaaccgttgctcagtttatcctgctggcaggcgttggacatgcgacgatgcgcgatggtgtagcgggaacattacagcaaattaaccatgctctgcatttgctctgtgccgcagcctggtttggcgggctgttgccagtggtttattgtatgcgcatggctcaaggacgctggcgtcaacatgccattagcgccatgatgagtttttctcgttatggtcacttttttgtggcgggcgtattgctcacaggcattggcaacacgctatttatcacgggatttaccgctatctggcagaccacttatggacagttgcttttgttaaaatgtgcgctggtggtgcttatggtagcaattgcgctgacgaatcggtatgttctcgtaccacgtatgcgacaggaaaatccccggactgacctatggtttgtcaggatgacgcaaattgaatggggagttggaggcatagttctggcgatcgtcagcctgtttgcaaccctcgaacctttctgatggactggcataacgaatgaaaaaaatactccttccggcgcttctgctggccacttcgggcgtagcgttggcggcgccgcaggtgattaccgtaagtcgttttgaagtaggaaaagacaagtgggcgtttaatcgggaagaggtcatgttgacctgtcggcctggccaggcgctctatgtgatcaaccccagtactctggtgcagtatcccttgaatgctattgccgagcagcaagtagcggagggtaaaacgcgcgctcagcctattgccatcattcaaatcgataacccggcaaagcccggtgagaaaatgagtctggcgccgtttatcgaacgtgcgcaaaagctttgtgatccatccaatagctgactgatttttaataaaaaaccgtaaaccttcacgaaaaggcttacggtttttttatctctgatgacagacaatacgccaggttttttcaatcaccttcgtcacaaactggaaaacctggcgtcgtcatctattcttaaagagcaaggcgatttagcctgcattaatgccaacttttagcgcacggctctctcccaagagccatttccctggaccgaatacaggaatcgtattcggtctctttttatttcgattataaatcaacgggttatgtgttttccctcgaaatttcctcgaatttctgtattccggtctttttggttatatcacaatcaaattcagtttaacatttcttttacaacaaaatcagagcatcacgtaagctttattatcgcgttcatcgagatagagtttcgtggtgttctctgaggtgtggcccagtagtttttgagcgaattcctcgccgcgttcgtttttgtacagccgaccagccaggctacggatcttgtgaaatgtcggtgggttatcactacatttaacgcctgaaatttttctggcttttacaaatttctttgtcagcccatccgggtgaatattcccggttgggctatttttcctgattccggcactgatcatgaaatcagttcggcttaccagtcggcagcgatcgattaaggcgggcaacggcatagacatgagtaacctgtgcatcttcgttctcacccggacggtgtaccagcttctcttccagaccaaactcgaagctgaaatcgtcaccttcacggacaacgcgcgcggaaaggctggcaatctgtccggaacggcgggcaaggtcgatcattccccggtagccaataattaactgaacgtttttttgcctgacttttcgtttttgtttccgaacggcagcagataggcatgaccgagcgcgccgccgggttccagcccaagctgggaacactgaacgatggcgctgacaaaactcatggtgtcacagtcacccagcgccggaacttttcggatttccgttgtggcataccgccggtacgccgtcaacttgcagcgccgcgtcatccggcagggccaaccccggcacaactgatgatggaaaaattcagacggcgtaaggcggcgggaaggctttaactggggggacttatgagcagaaattacacaccggcgcagaaagctgaaatacaaaagcgcctgacggaactggtacgaacacacggtcggatgacgtttggagaacttcggaagataacagggttaaccatttttacagcccgtcactacctggaaaaggcggaaagttgtggggatctgtatcaggccgggagaagcggtatttttccttcggaacaggctttcctgctttggaagtagaaacgtgaagatgccaggattacccgctttctgaaaacgccggaaggtgtcgtgagttcctacgaccggaccagaaacgttatctgtacggagtgccggaacagcgtgacgatgcaaagggtactggcattttatcggggaaattaccgggaggcgaaatctgcatgaaaatcgaataatataactttgcagaggtagcgaatatcgtaatcatccgtttggcatttgaattccgtgagcacagtcgtgttgtgaatgtcgccttgttcacaacaccaggaatattccactgtcaactggtgtctgcggctggacataattttatctgatattcaggctgtaccagcgcaaaggttccgtgagtccgactgtcttttttgcttccaaatattcagttttaattatctgagtatggcaaggtgatcttctgtatcaaacaccgggcaactggttttactttacccaacgattacgtccctgttgtttagcccgataaagggcctcatccgctctggcaataatgccggtaacagtgtcaccggctgtggaaagggtgatgcccatgctgacggtgaccgtttcgcttaccgcagatgctacatgcggcagtgcggtttcacgcaggtttgtctgaatacgtttagcaaccagtgcagcttcattcagcgacgacgaaggcagcacaacgacaaactcctcgcccccgtaacgtgccaccaggtctgccggagtacgaatcgacctctttactacacaggccacctttgccagacaggcatcgccagcctggtgaccataattgtcgttatagtttttgaaatagtccacatcgagcatgatcagtgcaaacggctccgtctggcggagagcatccccaagaaaactttccattgaacgtcgattagcggtcccggtcagtgcatcctggtgagccataacgtcgagacgcgcgataagcatccggttttcctggtaacgcaaccaggcttcatcaaaccagcgctgcaggataaagcgaccataaatgagtatggcggtaagagtaagccagactaataaaaaccggatattcacatactggttaagctgcacgctggccagtagggcggtcagccataacgggacgatgaaaagtagcaacgctggcagatgataataaagcgcagccagcgcggtaagcataaggatgacactgagaggccaggcaaaaggcagttgccaccagacaataaaacagtagctacaatagctccacatcagactgagaatcagcagcatcaccagacaaagaggagtaaatctggccggaaggcggtaaatgaaaaggagtatcaggaacgaaaaaacaataatactgcccataatatcgtctattaaaggcagtattccagtctgtgcactgatcgacttgtcaaagtcactgatgagtatgtggcgaaataaaatgataagcgcaaagctgatattcacaaatgtgaaccacggaatacttacacgtagcgcttgcctgaccatatctttatgatcctgccatacccttccagcactggaggtacggcgcctgtcgtccgaatcctgccccatccttaatcgcctcatataatgaataattactatccagtgtagtgcggagatacttcatggtgaaaaatggaaaagctatcaggccaggctgcatttttggctgatgagatgatttttgctccacagtgacgaacttatagtcacaattcctgtagtaggggggagaattatagtgtttcccggaaactggaagcgagtttaccccacttactaaaagaggatgtaactggcagacgtaaaacacgacttatttgtatccataaatagcgaaatgtaacgttttggttatatttaaaagagcgaaaatggtcagcaataactttaattgtttgaattaacagataattaatcgaccagactgagtgatacagaatatttttacatgaggggtacaaatgagacttaagtcgatcgttaaaagttttgcgctggcggggctactctcttccactgcgctgacacctttatttgcccaggaagccccaaaaggtgccactgcttcaaccaagcaagctaacaatgcgctttataaccaacttcctttctctgataacaccgatttcacgaatgcccataaaggctttattgctgatttacctgcagaggtgattaagggagagcaagggaatgtcatctggaatccacagcagtacgctttcataaaagaaggggaaaaatctcctgacactgttaaccctagtctgtggcgtcagtcccaactaatcaatatcagtggcttgtttgaagtaacagacggcgtctaccagattcgtaaccttgatttatccaacatgacgattatcgaaggtaaagaggggattacggttgtcgatccgctggtttctgcggaaacagccaaagccggtatggatttgtatttcaaaaaccgtggcaataagcctgttgtcgccatcatttatactcatagccatgttgaccactatggtggtgtgcgtggcgttgtcgatgaagcggacgtgaaatccggcaaggtgaaagtgtatgcgcctgctggctttatggaggcagcagtagccgagaatattatggccggcaacgtgatgagccgccgtgccagctatatgtatggcaacctcctgaaaccagatgcctccggccaggttggcgccggactggggacgaccacctctgcggggacggtgacactgattgcgcccactaatatcattgataaagacggccagaaagaagtgattgatggcctgacttacgactttatgctggcccctggttcggaagccccttcggaaatgctgtggttcatcgaagagaagaaactcatcgaagccgcagaggacgtcactcacaccctgcataacacttactcgctacgcggcgcaaaaattcgtgagccgttgccgtggtcgaaatatatcaacgaagctatagtgcgttggggtgacaaagctgaaattattatggcccagcaccactggccgacttggggtaacgagaatgttgttggtctgctgaaaagccagcgagacctgtatcgttatatcaatgaccagactctgcgtatggccaatgaaggtctgactcgcgacgaaatagcggccaacttcaaactaccggatagcctggcaaaaacctgggccaaccgcggctattacggctccatcagccatgacgtaaaagcaacgtatgtgctgtatctcggttggttcgatggcaatccggcaacccttgatgagctgccacccgaagaagcggctaagaaatttgttgaatatatgggcggtgccgatgcgattcttcagaaagccaaagcagactttgaccaggggaactaccgttgggttgctcaggtggtgagtaaggtcgtgtttgccgatccaaataaccagaatgcacgtaaccttgaagccgatgcgttggaacaattggggtatcaggctgaatctggtccatggcgtaacttctacctgaccggtgcgcaggagctgcgtaacggtgtggttaaaggtccgacgccaaatacagcaagtccggataccgttcgggcaatgacccctgaaatgttcttcgatttcctggctgtacatatcaacggtgaaaaagcgggtaatgcccgggcggtgtttaatattgaccttggcagcgacggcggaaagtacaagcttgagctggaaaatggcgtgctgaaccacacggctaatgctgaagcgaaagacgctgatgccacgattactctgaaccgtgacacgctgaataaaattatcctgaaggaagaaactctgaagcaggctcaagataaaggagaagtcaacgttaccggtaatgctgcgaaactggatgagatgctgggctatatggacaagtttgagttctggttcaatatagttacaccataaatagattccctgcggcgtcaatgctgcagggaagttacttcagacaattctgtacgtttttcatactcgatttttccttcattctttatatcttgcttcattttatgtatttgctgctgaagcacatgaccctgatgccagtcagtcctgattctgttatgcacagcctttttcatcagatgacagtaactggttgttgcgtgattcaatggtctgcgagtctggtcaacatgcttttagttagttaaatgtgattctactaattcgtaatgcgaaggttataagtttgattcctattattgcaccatttcaacgttactgaaacttccgtgttagcccataaccattccagtttctacaagacaggtgcttgctatatatttaccaatcagtcattttaaaagtgcgtcataaccggagaactgtcctcgtcaggaggcctgttttcagaaaggcaatatcctgcttcgacagtagcttatatgtgaccgggttagcagcacattcccctccgccacattccagtacagttgaaataaggttggcagtaatcagtaatagaaatacccaaccgacaatactgaacaggttcggattaatattcaatgaacgaaatgcagcattcatgctactgattgccagaactaccgcaacagcaataataatgagaattgacgtaatcagagtccaggtataaaagtgtaatccaaaaaatgcagaaccatatcctgtgtcaccgggcatgatatgcaaacatatttgccgggatgccataactccggtcaggatactgccaataattaccatcccgtaatgtatgcctcgtagaccaaagcagaggttaaataaaaagccaaaaccggcgatgatgaggccagcccgctgtaataagcaaattggacaaggcagctcatgcctaacgagttgataataaaaggctacaaccagagcaacgcatatcccaaggagtcctatctgattaatcagatgaacaaatgttgttggatgatgatgcgttttcatacacactccttaaaatgacaaagttagcgaattggtcatatgatggatgaatgataaaatagtgacgatgagtaaaacggcccatagaatgtagctgactttatcctttctgtttatggctcccattgccacgctcagtgcaagcaagaatggcagaaacatgaacataaaaaactcctttattacattgcttgttaatataatcgctgtgtattaccgggtctgtattccagcttatccaccccgcattagctggagctcagtaaggcatcaggaattatttgcgttattataaatcgattatttctgtgatgaattatcccgacatctgctggttacagggatatttctggcgacaagagtaagaaatatcccgatagctaatggtataataagcagcattgagtgtgttgaaatagcatatccataaatatagtcttccagacttaccgcaatcagcggaaagataagaaatacaagcgaagcctggaaggcgttagccttttgctgaagcgcaaagtagcacaggataccaaaaactccggcaaaagccccgagatacagggtagctaatattgagtgtactgagaaggttgatacttgtggtctttcaaaaaaccatcctgtcgcagaaagtatcaacccagctaaaaggcacgggagcgcattaaatgtgataacagagacagtacaacttcttttcttacattgtgtatatattatggcatggattaacacagcagaaataagcgcagtgataccctgccagtgactctctgtacttgtattcgtttcttcaagaagtatccccgtcaatgcagtgattgcgatagttaagcccgcgatctgcattagtttcgctttttcatttagaaacaaaaccgatgctatcaaaacggccacaggcatattcgcaaagataatggcggcaagcccagagttgacataggtttcaccataaatcattagtgagaaaggaatagaaaaataaaagatgcaaatcacaaactggaataatcgttgtccgggaggaaacaacaggtttttttttcttaaccatgcaatgatgattaaaaaaggtgctgcaaacataaacctcattccggttgcaaacactggagggatagtttcaacggcaattcgcatagccaaccatgtagtcccccaggtcagtgaaactagcatgaataatatagatatcgacaccttgcgcataagatcctctccataaaaaaattaatttagctttttagctagaaaaaagtagcgttttcttcactgtgttttttatatgtttagataaaaatttctctatcagaagacgcagttatgctgaatgagaaaaataagaaatgactcaggctgttaccacacgattgtccactgcgcctgcaagacctggcagcagttgtcgatttaatatctattcttgctggaaggcataaaacgccttgaagatgaagagctcatcattagtcgggttcccttgttgagccaggacaagtttaacttatcgctttcaacccttacgatgataaatgatcttatccacccataatggacatacggctaaatgagtaaattctcaagtaagaggcaggatctgtatcaaccagtaagaagtcccggaaacagcaccggcggaattccgtcaggaagctctgaaactcgctgaatgtacgttgcccgcgaacgattgttaatcagcgctatagcaagaataattgtttgtttcacaaggagatagaaaaactatagctttgcgccggggcggaggcaggaggagataactcgttgtaatagaatgtttttatatggcgaccttaagagaaatgctttcgcctcggtataccacccgctatgaagacctgcttcaggttaagtggcaggtttatccagattttcacattcctgatgtgatggaaccgcagccacatcgtatgcaagaacgggctgcggcaagctggcgatcgttcgatagtgcgagtattgaatggctgccagttgcggcggattttacttgttcaggatgactaaccaatgtgtttaatctgaaactagccacctgttcaacttttcgcgatcgcttttgttggcatcactattaagccttcgtctacatgggtatttggcatcgggagtcccccaatggaagaggggagtgatgtattgggcagtgagtttgtttggtcgggagatttatacgcaaaatggcccgaaatacgtccgaattaaaacgtaaaaagtgataactaattgaatctattagaatcaaaaataacgtgttctaatcgttaaaatcacctaattaatatgtaacattatgaatttaaagggaaagatcaattgttgccgtaaacaggaatcgtattcggtctctttttgtttttcttataaatcagttgcttatgatcaataatccgaaatttccgaaattttccagaatttctgtattccgggctttttcgttatatcagatccaaatccagtttaacatttcttttacagcaaaatcagagcatcacgtaagctttattatcgcgtttgtcgatatagagtttcgtggtgttctcggaagtatgtcccaggagtttctgagcaaacccttccccgtaagcatctttatatagtcgtccggataagctgcggatctcgtgaaatgtcggtgggttatcactaaatttattccggtaaattttcgtgccgcaacaaattttttagtcaggctgtcaggatgaatactcccgttcgggcggtttttgcgtatgccagcgctgataaggtattcgctacggcttaccaggcggcaacgatcaatcaccgtactgaggcgtaaacccatggaaggaggggtgagcgaaagtggcagagcgattttcatctcggtcttgattggcttaacgtacagtcgctcatcaataatgtgactgaactgagactgtaattaaaattgtgtaattgcctgtttttgatatgttcactccagtaacggagacaggcaattatggacgaaaagaaactcaaattccttgcggctgaactggctaaaggccttaaaaccgaagccgacctcaatccgttttcccgtatgctgacgaaattaaccgtcgaaacggcgctcaatgcgtagctgactgaccaccccgggtatgagaaaaacgcccccaaaacaggctcaaacacccgcaatggctactcgtcaaaaacggtgttatgcgatgacggcgagatcgaactgaacacgccgcgtgaccgtgaaaacaccttcgaaccgcagctacttaagaagcaccagacgcgcattacgcagatggacagccaaattttatccctctacgccaaaggcatgactacccgcgaaatcgtcgccacctccaaagagatgtacgacgccgatgtgtcaccttcgctgatatctaaagtcaccgacgccgtaaaagagcaggtcactgagaggcaaaaccggcaactggatgcgctgtaccccattgtttatatggactgcgttgtcgtcaaagtccgtcagaatggcagcgtaatcaacaaagccgtcttcctggcactgggtatcaacaccgaacgccagaaagagttactgggtatgtggctggccgaaaatgaatgcgaaaagttctggctaagcgtgctgacggagctgaaaacccggggccttcaggacatcctgattgcctgtgtggatggtctgaagggcttcccggatgcgataaatagcgtcttcccgcaaacccatattcagctgtgcagtatccatatgatgcgtaacagcctgaaatacgtagcctggaaagactacaaagccgtcaccagcggccggaagatggtctatcaggccccgaccgaagatgcggtactgatggcgatagatgcgttcgcgaaagtccgggacgataaatatccgcaaatcagcaaaagctggcgtgcgcaccgggaaaacctcaatacgctcttcagttatccgccggatatccgcaaggccatctacacgacaaacgcagtcgaatccctgaacagcgtgatccgtgccgcgataaagaaatgcaaggtgttcccgacggatgactcagtacgaaaagttatttatctggcgatcaaggatgcgtcaaaaaatggagtataccgctccagagctggtggctggcgatgagccgttttattatcgggttcggtgaccgcctgatgctgataattttagtcgtgaggttctttcttctgcaccgggtgggcgcatttcataactgcaggaccatttgctgaatactgtatagtccagtactttgcatgttgttgagatcagtgtgcaattcctcggtactggcttgttctgtataggtctggagatttctgggtagtgtccttgtggacctgaacatatgtttttgattgaaaatggcatcgtgttttatcatttacgctgtgaaatgttgttttgtgctcttctgttgtgattggtgatgtgacgggatcgtccatgcacccttccttttattgacggcgtatcagtccattgatgccatgctcgcttaatttgtccagcatcatcaagccgtcgttttctttctgctgcaattcaagcaacttaaaccgtatttcgttaagtaaaggtttaataactccgcgcttgcgaaccacctttctgataacgtctttttcgaagtataaacggcagaagtgattttcataattcgcctacactcttcacccagcgctggcaaatcttcaacgctgaaaggctggggagaaaggcgtccagttgctgaacggagagcgtaccaaacgccctgattccacgcgttatcaaacttcataccgtggtcatcatccagacaaggcgcttgaggttgcacatatcttttggggaaagaggttcggcggtggatactggatatcctggatcgggaagtgggttccactggtgccaaatacagtgggctggtaaaccgggtggatacctcaaatcctgacaggccagagtatcagcctgataaaatcgtattactgatttctaaccagtggcacattaattgtaccagctcagactccaactgacagtttgctttaagcgagtagcggacgtgacctgccccgcaggagtaaaaataaactttctattgatacatttaattaacttatttataacgttatattccaaatgcaaacttgttcaattggatatgtatggacattcaaattacacatcaagttactgaatttgataaagaagaactattagccggattaagaagctacaatgctcagttcgtcgattttagtaaaaatgggcagcttggggtctactgcagaaacgaaagcggcgaaatggtaggcggattaattgctgacagaaaaggtccgtggctttgcatcgactatctttgggtaagtgaatctgcaaggagccgcggtctggggagtcaacttatggagatggccgaaaaagaaggtttgcggaaaggctgtgttcatggacttgtagatacctttagcttccaggctctccctttttatgaaaaacagggtcatatacttcaaatgtcgctaccggactttcctaaagtaggttcgcaaaggcattatttaattaagcctgatttatagctttgctacatttgaatacccatagccttatgaaagctgcaatcaggtagctttaaaatatatcgtattgttggcctgtacacaccatgttcagcgtccgcttctggcgcagggcggacagtcagattaggtttggcgctgtgccatagatatgtcagctcacatttgagctaataccccctggcacggctagaggtactcagacagccgcttgtaggcggcatggtacggatacaaaaacatatagcgctgttatataaactgtaaactgggctgtgcgtataatacgaatctttcactcagagaaacctgctgacagcgttagtgctccattaattaattttgtactaaatctctgtggtatggcacagacgtttagaagacaggtcaattgcgagctgctggctgggatttcgtcgcgccactcaaaaatgcacagagtttttcacccgccgtcaatggctcaatgggcgtttttccgagggcggtctcagtcatgacgatggcaggaccaataagcatggaccatacttcgctcgcgtcttgctcaagcgatgtgaaggcaaggaacagtgtcttatctgaaggaaagcggtgctgagtattaaaaagtttcagccaggcgcgggactgccggtcggcctgtgttgagcgcgtgccgaagcggagtactctttttagtatggcgatacccacaatgcctggccccagaataaagggactcccgacgtttatggtgacgccgaccccgagaaaaacgagggcgaatgacagcacgttatctactcttctggtaagagtactgtatagtttttccagagagtaccggtaaagaatttgataactgatttcatctttgctcatacatctccagatggtttttcgattacgctccggtatgctcccggaatcctgacagattctgcaattatgccacacttcctggagagtattaattagatagaatataaatagcaggcaaatattttgagcttttagtcgatatcgctttgaatatcatttctcctgcaccaggagatgctgttgtcgagcatcgtgtcaaacgttgctgcgtcggtcggactgcacaggataactctcgcagtcagactctcattatggtctctaaatggataacccgcagtcgcaacacgccggatgtcacgactgacgctattattacccaggtttgttaaagcggcatgaccacattttctatatataataattggttgtctttcgaccagtattgtcgagtttttttgtttaattccacaatccatttaaaaacgcctgccgttgccagatcggtacagtatttttcataggaatgctcgcccgaaaagtgtttagctgaagtcaattttattaattgcgtatttggtgttgaattgactttaatcagctttctattgcttttaatagaaatgaaatggcctgcatgagtgataattttcacattaccggtagcaacaaaatagatgtaataagcgatattattatattccagatcgattagaaatgcgttgaaatttgcatcctttctgacacgctcgaaaaagtggttaagcataagctgtaattccatttgttaacctattgtaagttataatgttgaatgttgtgttagagtattgttgtttaaaagcagctatacagatatgctacctaaaagcaataataatcgtctggtatcatatagtttacgttatgattggaatagtgttgcaattgttactgattatttctcgtagcgcgtttttttgaccactaatagatgagtcaatccatttcatttgtagtttttctgaacgccatgaaaagtcataatatataaaaatcagttaattaattgatttttagataaggattacagtggcggagaggtttggcgtggcgactttataggttttgaaaaagcggctaactcgctggcaggataattggtagccagcctgcgaatgggggcaaaatcgtaacaacatcagcataaataataatgttcatgaatgttttgtgtgacgcagcagttgaattgaagtgatgttttgcctgttcaggattgtcccgataaaaatgttcctcgataaaagtcgatcaccttgcgccgaaaaaaaacaggctaagtgacagaagaacaaaatccatcaggaaaataaaatttataaatatcaatgagtaaaaatggttgtggagaaggtggctattttttgaaagcaagaaatataaacaaagtgtagctatgcatagttatctaaaaggagaactaccgtgactaacataacactatccacccagcactacagaatccatagaagtgacgttgaaccagtaaaagaaaaacaacggagaaggacatttttgcaaaaagtattactgccgttagaaatagctttatcagcctgtcgacgagtctgtcagatcgttttagcctgcatcaacaaacagacataccgactacccattttcatcgtgggagcgcctctgagggtagggcagtattaaccagtaaaactgttaaagattttatgctgcaaaagctcaatagcctggatatcaaaggtaatgcgagtaaagatccggcctatgctcgtcagacatgcgaagccatattatcagccgtgtacagtaataataaagatcactgttgtaaattactcatcagtaaaggggtcagtattaccccctttctgaaagagataggagaggctgcgcagaatgcggggctacctagggagataaaaaatggtgtatttactccaggtggggcaggggcgaatccttttgtcgtccccctcattgctgcagcgagcattaaatatccgcatatgtttataaatcataatcagcaggtgtcttttaaagcgtatgctgagaaaatcgttatgaaagaggttacgccgctgtttaataaggggacgatgccgacgccacaacaatttcagttaactatagaaaatattgcgaataagcatcttcagaatgcctcctgaagatagcaaacacaataccgctattaaccgtatgaattaatagcagattttctgaaactatatattcatttttatggcgacgcttttaacaaaacgtcgtcatatttattttaatataaaaatcaaatggatacacttaaaacttaaaataattgttattactctaaatgccggtataaccagacagctttttttgaaacgctgcgtgttgttaagtctatgatacccgcgcacggatgatgtctcgataaggattaatggtctgttaactgtcaggagaggttatgccacctttaaaaaaaattgtgctgcgcctgtttgtgggggcgatggtcgccacggtaacgacacctgcattggcgctggtttgccttgaggatcactccgctaaagagtgtgctatatcgtgtgctgaggtgatgtggtttatgtttccgatatgtttttaaggagggagaatattgaacgcgaacaggtgatagtgagtagctcgctgcgccaggggataacactcccctggtgcagtcagttatattttattgcgatgataacaaagcatttactcgctactgatgaaattcgctatttacaacagagcacgtttactaagcaagaaaatctgcacacgctatctttttatatctatcttggataatgaacgacaggaaaaacatgatgcggcctgaagagatttatcagcgaatagaggcaaagaattggcggcatgtctgggtggtcggcgatattcacggctgtttttcaatgttaatgaaaaggttacgtgagtgtcaatttgatccgcaacaagacttgttagtttctgtgggcgatctcattgatagaggcccggacagcctgggttgcctggctttactgcgtgagtcctggatgacggcggttcgcggcaatcatgaacaaatggcgctggatgcgcgggcctcatcgcagtcgacgctgtggttgatgaatggtggcgactggtttacccgcctgacggctgaacacgctgcgcaagctgaagcgctttttattctttgtcagcggctgccctggatactggaagttcgctgccgccatagcacgcatgtgatcgctcatgcagattatccagcgtcaacctatcaatggcaaaaaaaggtcgacttacatcaggttctctggagccgcgaacggctcataaataagcgcggcgggattagcggagccgatcatttttggtttggccatacgccgttgcgtcggcgcatggatttcgccaacatacactatattgatacgggcgcggtatttggcgggcaattgacgttagcgcggatacaatagcggcatcagcgactagggttaaaaatcgctatattgctgcgcaggtcgccagaagccgtcgataaaatcctctaccggaaaacagccgccatggcgaatccgttgatcgtccatcgaataaagacactgctgctcggtatcgtagatgtccacgacaatatcctcgcatcctccatccaggtaacatacaaaaagtaccagcgcgaacattacatcctcaatgttaactactttacacgatagtgtaggagaggttagcgcaggggggaaatgagaaaaggaagaataaataacccgcctggcgacgggttctttttgagtcaggcaagacgcatgacccaggcatcagatttaggatcgtaatgattacggaacaaaacggaatgttccccgttgagaatggcgggaacgctggtttcggcatcccaggcgtccagttgcatacataaatccggatcggatttacaggggattgttaacgttcgctcccccggcgattcgccatgtaattcggcatcgtcgatttcaaaagcgccaatgcgcacactggttttcatcatcgtgctctccgttaatacgctaattgtggtacgaccagtttagccgtccatttttcagcgtagtcaacgtacgcaaaagcgccagtcaaaaagtgcggtttttttgtgcgccttttaactattaccagtaaagagttttccatcccgcaccagttcacgcgggtaactgttctttattctggcgccgatacgttttgccagaccaagtggctgatgctggaacgtcaccaggacatcatcagcggcagggggtgtttgcggataaatatcccgaccgcgataccactcctccgcctcttgcacagaaagttcgaacgcgtgagcatgagtcgggcaggcaagggctatcgtcgcctcatgttgccagcgatagcctttattatgactttcggccagcttaatgccgagccgggaaaaacggacttttccgatcagtgattcaatctctgccgggaacagccagacctctttttcacgctgccaaagatggagattttcatcccatagcagtccgacggcgttggccgcctgggtaacgtttaatgcttcgcggcctttgagggaggtaaaaggaaacgcccccactttataccccggcgcgggcatggctggaagggatgacattttacgcagacgtgcgacgaagaatccttcgcagtcgtaaatttgcgggaagacgtgcaggaagccttccggggtgagggcgcggtcagcgtcaggaaacagatcacccagcggcaaaaattcaacggcgtcggcgtaggtctctttcagccagaggcagaccgcttcgttttcctggcgatttaacgtgcaggtggagtagaccagcgtgccgccgggtcgtaaagcatgaaaagcgctgtcgagcagttcccgctgtgtcgccgcgatatccagattactttctggcgaccagttttttagcgcatcaggatctttacgtactacgccttcgccagagcagggcgcatccagcaggatagcgtcaaacatctccggtaacgcagcgccaaatacgcggccatcgaaatgcgtcagtgcggtattggcgattccacatcggctgatattagcgtgcagaactttgacgcggctggccgaaaattcgttggccagaatggcgccgcggttccccatgcgggcagcgatctgcgtggttttggagccaggcgccgctgccatatccatgacccgctgcggatgattatcatcggcgaacagggccgcgaccggcagcatcgaactggcctcctgaatgtaaaacaggccgcttaaatgctcagcggtactgccaagcggcaatgcctcttcatcatcgcgctcgatccagaatccttcatgacaccacggaattggcgtgagcgaccagccgtagggcgcgattagggcaaggaaatcagccacggatattttaagcgtattgatgcgtatactgcggcgcaacgggcgttggcaggccgaaataaattcatcaaaagagagcgtggaaggcattgcttcacgcatttgcgtcagaaaagcgtcaggaaaatagacagcgtgttgagccacaggtgtatcgccggcaaaaaaacaggcgcgcagtgtagcataaaacgctccggcgcgagtacgccggagcctggtgtttaacgtggcagagcggtaccccattcacgccactctttcggttcgctctcttgtaacaggaaatgcttaccggcttgcgcttttggcgccagcggcgtacctggtggagtagcgaaggcgataccgccacggatgaattgattaaatgtccccgttttcaccacgccgcctgtcagaccaaagtcgagactatagccggaggcaagccagaatacggagttattacgcaccagatattggtaacgcttactgatgcgcaaggtgatcatcacgcgatcggagagcgaccccagggacattccggtgacggttcccacttcgataccgcgaaacaggacgggtgtgccaatattaagcgagcctgcttctggcgcctccacgacgatgcttaacccatccagatagcgtgagtcggtaatcgtggcttcctgcagttcaaagtcgcgccgcgccgcgccgcgtcctggctcaacgttaatatagggctggagaatcgtatccagatgctcgacgcccgccgcggagatttgtggcgtaataacggaaaaacgtgtcccggcgcgggcaaatgtttgcacgtactccggataaagtacggcttttgcctgcacttcattacgtgcggtgatcaattccagcgtctggatctggccgatatcaataccgaggtaacgaatgggcatcccctccgccaattttccggcgtcgaacgcgtgtagcgtaatttgtccgcctaccgcgcgggcggaagtttctgaagcataaagaatgcgtttatcgcctttgcgccgactggcgctggcgccgctcaggttatcaaaactaatggcccctttcagcgcacgggagagtggcgaggcctgtaccgttaggccgctgccgttaagttgcaccttcgcgccgccttccgcccagaacacgctattgctggttaacaggtggcgatattccggcttaatatgcaggtcgatgtcaaaggtattggcgcgtgggcgaacggtgatgacttcgcctacttcaaattttcgatacagcacgacggaacctgcctggacatccggcaacgtttcggccgtcagcgtcagggtggtagtcggtaagtcactgaggctattttccagcgctttttccaggttagcatagagcgggtaggtggatttcatcttcccgctcgtaccgggtaaaatacgaattccgccgtcaatccactcgctggcgctggcgccgaggaactctacgccgtcaaggccgactttgacatccacccggctgttgaccacgaatttactgtcgccctgtaccaaatcccggtgctgcggttcaatcgcgacgatgaatgacacgcctttactggataagttgcgctcaatgacctggccaatttttacgccatgtaaaattaacggctggcccggttcgatgccgtaactttccggggccgtcagcgtcagggttaaggcattcgcctcatgcagcagggctttttcacccggcaccaccacaaattcactgcgtggttcgccgtcgcccggcaccagctcgaaggtttttccggttaacaacgaactgatattcgcgtcacttagcgacagtttgggattgcgtaactcaatacgcgtattttcccgcatcagcggaacaacgctgggatcgacggtcatctctccggtgactttgccgccagggttgagcgtcagtttagaaagctcacccacctccagtccctggtacattagcggcgtagattccgctttcagaccgtctccgctgggcagctcaagtttaacgattacccctcgttggctgtgggctaaatctttatataagccgaacgtgtcatcctgggcggcgggtttggaattgtccggtgagtcaaacgcaatcgcgccattgaccagggccgcgaggctctccagtttcaccttcgcgccgctcaggcttagatcggcgtcaatgccggagacattccaaaaacggctgccttttttcaccagatcggtaaaccgtcgctcaatcagaacgtcaatcgtcacgccctgtttgttagggttaatcgaatagtcatacacccgtccgacagggattttacggaaatagaccagtgaaccgctattaagcgaaccgagatccggcgcattgagatgaatcatcagatcgccgttgctaagccggtatttaggctgtgtatctagggcgacgaaatgatctctgggcttgcctttacctggcatcataccgatgtaattcccgccgaccaacgcatccaggccggaaacgcccgccagcgaggctttgggcgtcaccagccagaattgcgtctcttcgcgcaacgcatcttccatatctgatttgatactgacgcgaacttcaattttgcgcagatctttgctcagactgacatcttccacggtgccgacttctactccctgataacgcacgggagtacggcccggtacgataccgtccgccgacataaaatcgatagtcacgctattgccgcgatcctggtagctatcccataccagccaccccgcgatcattagcgcgataagcggtagcagccagaaaggtgaaatacggcgtttggttttaatttgcgcttcagtcttcgaagcgggcgtttcctgactcatgtgcatcccaaagtaagcggctatccagccattccactgcaagaatagtcaaaattaccgctgcgccgaaataaaacgcagccggtcccatagtaaaagccagaatctgatcgcgattaatcagagacatggttaacgagataacgaaaagatccagcatcgaccagcggcctatccatgtcaccagacgcagcaacagaattcgcgtccgcagtccctgttggcatttaaaatggatactcaacagtagcgtaaacatcacgatgactttggtaaacggcaccaaaatactggcgataaaaacgacggcggcgacggcgatattgctgctggcaagcgacataatgcccgacaggatagtatcttcctgacgcccgccattaatgtagattaccgagataggcagcaggtttgccggcagcaaaaagacaatagacgccagcaaggccgcccaacacttctgtatgctctgttttctgcgtaaccgtagcggaatatgacaacgcgggcagcgtcctttcgcatccggatagccgctaaagtggcagccaagacagacgcgcaatctttcgtccgcacgttgagcagggtgctgcggataaaatcgttcccatagttgctccacattcagatgaatcatagtcagaatgctaagaaccaccaacgagacgaacgctaaaagcccaatgcccggctgcagaaaggcatagtcctgcactttgatagaggcaacgccaataccgaccagatagatgtccagcatcacccactctttcagtttttccagcatcagcaggactggacgcagattcatgccgagaaggctgccaaaccacaggtaagcaattgaaaaaaccagaataagcggcgcgcccaccacgcaaaagagcaccattgcggcggttaacggatcgccctgctgcgtcatttgccagatgccgtgcatcacattggcatcaatgcgtacgcccaacaggtagatatggagtagcggttcactccaggcaaacggcatcaatagcagcatggttactgccatcgcggtcagccgcgtcagcgaccagtcgcgcccatcgcgaattttggcctggcaacgaggacaataagcgctttgatgagcgctcatctccggcaagctgaacagcatgtcgcattcagggcagcgctggtagtggctgcgcggcagcgcttcgctaactgacctgatcgttagcttttttgttggcgtgacgtgtgaggtgttcagagccatgtatcgtgaatcaaagtgttagaataatgtaatcttaactcatgacaggaataatcttgaacaagaacgcatttaatgcttattttaatagcctgtgtttaggagtaagaccacgaagtgattatataatgagcaaaacagaactatacgcggcgttaaaccgcgattttcagtcgttaatggcaggtgaaaccagctttctggccacgctggcgaataccagcgcgctactgttcgaacgtcttaccgaggtgaactgggcgggattttatctcctcgaaggcgatacgctggtgttggggccgtttcaggggcgaatcgcctgtgtgcggattccggttggtcgcggcgtgtgcggcgcagcggtagcgcagaataaggttcaacgtattgatgatgttcatgcgtttgacggccatattgcctgtgatgccgccagcaacgccgaaattgtgctgcctgtcacggttggcgaacggattatcggcgtgctggatatagatagcacggcgtttggccgttttaccgaagaagatgaacacggcctgcgtacgctggtcgcacagcttgaaaccgtgcttgcaacgacggattacaaaaaattctttgcgagcgtcgcaggataatcaacggataacgtagcaattactgatagcgtcattataatgacgcctgttcatgcctgctgcttgttggctacgtccgttgtaatcaggaaatttcatggaaaatcaacctaagttgaatagcagtaaagaagttatcgcgtttctggccgagcgttttcctcactgttttagtgcggaaggcgaagctcgcccgctgaaaattggtatttttcaggatctggtagagcgagttgggggcgaaatgaacctcagcaaaacgcaacttcgttccgctttacgtctttatacttcaagctggcgttacctgtacggcgttaagccgggcgcaacgcgcgtcgaccttgatggcaatccgtgcggcgagctggaagaacagcatgtcgaacatgcgcgtaagcagcttgaagaagccaaagcccgtgttcaggcgcagcgcgcagagcagcaagcgaaaaaacgcgaagctgccgcggcggctggcgaaaaagaagacgcgccgcgacgcgagcgtaaacctcgcccggtagcgcgtcgtaaagaaggcgctgaacgtaaacctcgcgctgataaaccgacgacgaaagcgccgcgtgcgcctcgcgaagagaagcacacgccggtttctgatatttcagtattgaccgtagggcagtccctcaaggtgaaagcgggtaataatgcgatggatgccaccgtattagaaattaccaaagatggtgtccgtgtacagctgaattcgggtatgtctttgattgtacgcgcagaacacctggtgttctgaaacggaggccaggcctggcatgaacactttttttaggcttaccgcgttagctggcctgcttgcattagcaggccagtccttcgccgtggaagatattacgcgtgccgatcaaattcccgtactaaaggaagagacgcaacatgcgacggtgagcgagcgcgtaacgtcgcgttttacccgctcccactatcgccagttcgatctggatgaggcattttcggcaaagatttttgatcgctatctgaatcttctcgactatagccacaacgttttgttggcgagcgatgtcgagcagtttgcgaaaaagaaaaccgtgttgggcgatgagctgcgcacgggtaagctggatgttttttacgatctttataacctggcgcaaaagcgccggtttgaacgttaccagtacgcgctaaaagtgctggaacggccaatggatttcaccggaaacgatacgtttaacctggaccgcagtaaagcgccctggccgaaagatgaggctgagctaaatgcgctgtgggatggtaaagtgaaattcgatgagctcagtctgaaactcaccggcaagagcgacaaagaaattcgcgaaacgctgacgcgtcgctacaaattcgctattcgccgcctggcgcagaccaacagtgaagatgtgttctcgctggcgatgaccgcttttgcgcgtgaaatcgacccgcatacgaattatctttctccccgcaataccgagcagtttaataccgaaatgagcctgtctctggaaggtatcggcgcggtgctgcaaatggatgacgattacactgtcattaactcattggtcgccggtggcccggcagcgaagagcaagtcgattagcgtcggcgatcgtatcgtcggcgtagggcaggccggaaaaccgatggtcgacgtcattggctggcgtcttgacgatgtggtggcgctgatcaaagggccgaaaggcagcaaggtccgactggaaatactgccggctggcaaagggacgaaaacgcgtattatcacgctgacgcgtgaacggattcgtcttgaagatcgcgcggttaaaatgtcggtgaaaaccatcggcaaggaaaaagttggcgtactggatattccaggcttctatgttggcttgaccgatgatgtcaaagttcagcttcagaagctggaaaaacagaatgttaacagcatcgttatcaatctgcgttcaaacggcggtggggcgctgacggaagccgtttcgctttccggcctgtttatcccttctggtccgatagttcaggtgcgcgacaataacggtaaagtgcgtgaggatagcgacaccgacggcgtggtctactacaaaggcccgctggtggtgctggtcgatcgtttcagtgcttcggcatcggaaatcttcgctgccgcgatgcaggattatggtcgcgcgctgattgtcggtgagccgaccttcggtaaagggacggtacagcaatatcgttcgctaaaccgaatttacgatcagatgctccgcccggaatggcctgcgctgggttcggtgcagtacaccattcagaagttttaccgtgtcaacggcggtagtacgcagcgtaaaggggtcacgccggatatcatcatgccgactggcaatgaagagacggaaaccggagaaaaatttgaagataacgccttgccgtgggatagcattgatgcggcgaaatacgtgaaatcggacgatttggccccgtttggcccggaattattgaaagagcacaacgcgcgtatcgccaaagatcctgagtttcagtacatcatgaaggatatcgcacgtttcaatgccatgaaggataagcgcaacatcgtctctctgaattatgcgcagcgtgagaaagagaacaatgaagaagacgctctgcgtctggcgcgtattaacgatcggtttaaacgtgagggtaaaccgttgttgaagaaactggacgatctgccaaaggattaccaggagccggacccgtaccttgatgaaacggtgaagattgctctggacctggcgcatcttgaaaaagaaaaaccagcggagcaagcggcaaccgataagtaacgctaaacaggcacaaaaaattgtgcctgttttttttaacaagcgcagaagtcgtcaggataatgctacaaaatgtaaagttgtgtttttctcgtgacttaccgcctggtgatacttgaaaatagccataagacccatacgatgtgggtaatcgcatagtgcgctttgttaaattgaggttaaaagaaaattatgatgcgaatcgcgctcttcctgctgacgaacctggccgtgatggtcgttttcgggctggttctgagcctgacagggatacagtcgagcagcgtgcaaggcttgctgatcatggcgctgctgtttggttttggcggttcttttatttcattgctgatgtccaaatggatggcgttaaaatccgtaggaggggaagttattgaacagcctcgcaatgaaagagaacgctggttgatgaacaccgtagcaacgcaagcgcgccaggctggtatcgccatgccgcaggttgctatctaccatgcgccggacattaacgcgtttgcgacgggcgcacgccgtgacgcctcattggtcgctgtgagcaccggtctgttgcaaaatatgagccctgacgaggcggaagccgtcattgcgcatgaaatcagccatattgccaatggcgatatggtgacgatgacgttgattcagggggtggttaacaccttcgttatctttatttcgcgcattatcgcgcaaattgctgctggttttctgggcggcaaccgtgatgaaggcgaaggaagtaacggtaatccgctaatctatttcgccgttgcgacggtgctggaactggtcttcggtattctggcaagcattatcaccatgtggttctcccgttaccgtgagtttcatgccgatgcgggatcggcgaagctggtgggccgtgaaaaaatgattgccgcgttgcagcgcctgaaaaccagctacgagccgcaagaagcgaccagcatgatggcgttttgtattaacggtaaatcgaaatcgttaagcgagctgtttatgacgcacccaccgctggataaacgcattgaagcgctgcgtagcggcgagtacctgaaataataagcccactggcaagtatgaaaagcgcgtcgaatgacgcgctttttttacgcctgaacgcgtggttgcgtaatacgtaaaccgctcaccaccgccgcgagagtcgccaggatcgccgccgcgagcagcgaaagatgcgtaccgctatcgccaaactggttcaacatcagcgctaccagcgcggcgccagtactttggcctaacagtcgcgccgtgcccagcatcccgctggcgccaccgctgcgctcacgcggcgcggaagtgataatggtgtgattattcggcgactggaacaggccaaaccctgcgccgcaaaggatcatcggccagataatattcagatcggagggggtgcctggcaacatgaccagcgcaaacaacccggctgccattatcaccattcccagcgcccccagcaaaccggcatgaagacgttctatcaggtatcccgccagcggcgccatcaccatcgttgccagcggccagggcgtcaataacaggccggtttctacttcgctacggcccagcacggtttgcagataaaaaggtagcgagaccatggctaacatttgcgcgcagaacgagcaaattgacgtgccgatcgagagtgaaaaaagcggaatgcgtaacaagtcgatgggtaacaaagggacgggcaaagaaagctggcggcgcacgaagaaaaacccgaccacgaccagaacgagcagctctgcgccaatcaacgttagcgactgtccctgggcaaagccgctcaatgcggtaatcagcagaccaaatgtgagcgcattcattaccgcgctcggtaagtcaaagcgcggcttagtgtcatgggcgatgtttgctggtaaaaagcgtatggccagaattaacgcgatgatacctaacgggacattaatcagaaacagccatttctatgatgagatggacaaaatcgccgcggcgatcgtcggacccgcggcggaagagacggcgacgataaaagagttaattcccatacctcgtcccagatgacgctgggggtagataagacgaatcagcgccgtgtttacgctcattagcgccgcgccgccaaattcctgcgcgatgcgcgccagcgtcagcatctgcagcgagtctgaaagcgcgcaaaacaatgatgaaagcagaaataccactaaaccacatttatagatccggtgataaccaaacatgtcgcctaaaaaagacagggaaagtagtgagacgacaatggcgatttggtacgcattgacaatccagatagagctggcaggggaggcatgtaaatcagtcgcaatggttggcagcgcgacattagcgattgcgccatccagaaccgccatcgaaataccgataataatcgtcaggatagcgccgtatctctgcgggaggggcagccgtcggcccgtgttttttccataagtattttgtaataaggggaattatgagctgaataataatgttagcattaatactgagttgttatgtcgtagatttgtaacgaagtaagcaaagatggattgcgggcgacctggcgtgaaattataataaaaactcgttctgaattttataaaacgctcgtaatgaggtgataaatggcaaacgcagatctggataagcagcctgattctgtatcttctgtgctgaaagttttcggcattctgcaggcgctgggtgaagagcgtgaaatagggattaccgagctatcgcagcgcgtcatgatgtcgaaaagcaccgtttatcgctttttgcaaaccatgaaaacgctgggctacgtggctcaggagggggagtctgaaaaatactctctgacgctaaagctgtttgagctgggcgcgcgagctttgcaaaatgttgatctcatccgcagtgcggacattcagatgcgcgaactgtctcgtctgacaaaagaaactatccatcttggcgcgctggatgaagacagcattgtctatatccataaaattgactctatgtacaatctgcggatgtactcacgtattgggcgtcgtaatccgctgtacagtacggccatcggtaaagtgcttctggcctggcgcgaccgtgatgaggttaagcagattctcgacggcgtagagtataagcaaagcacgggacgcacgattaccagcactgaagcgttgctgccgctgttggatgaagtgcgtgcgcaaggctacggtgaagataacgaagaacaggaagaagggttacgttgtatcggcgtaccggtatttgaccgttttggcgtagtcatcgcagggttaagcatttcgttcccgacgctgcgtttttcagaagaacgcctacaggaatatgtggctatgttacacgtcgccgcgcgtaaaatttctgaacaaatgggttacaacgattatcccttctaagcaacgttattagcatgacgttaaaaaaaagcagctacatttttcgtagctgctttttttataacatcgggtgggatgaaatcgtaaaagtagataatatctgtcggcttatttaacggttattaaaatattatttaacagtacttatgaacaacagccaatataggggaattattggtgatagtttcactgtgaaattatttattgccgcttagccattatccaccacggtggcgatttttctgaaaatgggacagtcggaaaagccgataatgccgctgttggtatggagatattgcgccgtgctggtgccgcgtgcggtcaggtaatggcactgtaaacccagccccgcagcgttcactttacttcccaccaggatgccatagccgctcatcagcaggcctatccacaccagggcaaacaatacaattgcgcgaatgatcaaacgcattactacctcttttttagttagaataagagtagcgtgtacattgattgaaacaagtgaatcattcctaaaaacatataatgccgctacagttactcctggtttaagtaacttatgataatttagcgacataagatgtaagatcggagagtggagtgaaaaaatttcgatgggtcgttctcggcatcgtggtggtagtatgcctgttgctgtgggcgcaggtgtttaatatcatgtgcgatcaggatgtacaatttttcagcggtatttgcgccatcaataaatttattccctggtaaacgttttacaccagagatttccttcccgtgtagcagtggtagaatgacgtctctacattgaggtggtgaaatgaacgacgttttaaactctggtgcgttttctcttgcatctttaatagtatcaatggtggttctggtggtggggctggcgctctggttctttgtcaaccgggcaagttcccgtgccaacgagcagatagaactgctcgaagcgttgttggatcaacagaagcggcaaaacgcgttgttacgccgcctttgcgaagcaaacgaaccagaaaaagaagcggaacccgcaacagcggcaagcgaaccgaaagaggatgaggacatcattcgtctggttgctgaacgataatgcttaccggggcgcaaatggcgccagtgccatacgccccatttccccgtcggatctctccgcgttgccgtttgcaactgatactacagcatcaacaccttacctaatatatggctttatatgcaacatagttttatatgtataacaaatggacatatggcatttttgtgataccgctcattctctattaaaagcgaaacgtttctctctctttatggattgtcattgtttgttcattattttaaggcattctgtaaagacgcagaacatcacaaaaagcggtgtcgaaaatcgcttttcttttctattattttgattaaaaggtgttttttatcattgtgacaatttatgcataactcagcataaaaagtgatatgaaaaatacagcttttaaatgtgatttgatgcactggaagaagcgaaattattgagctatggtagaaaaatggcttttcagcagtgacgttgtcaggagtccgtcagcgcgtgaggatatatctttcgcaattttgttgcataaacgtgttgtcaatttgtgaaggttctcgtaatttgtgcgacggatcgagacacgtttaaaaatggcttgccataattaacgttatatgtgataacaggctttgggttaaacgaggtacagttctgtttatgtgtggcattttcagtaaagaagtcctgagtaaacacgttgacgttgaataccgcttctctgccgaaccttatattagtgcctcaagcagtaatgtctcagttttatctatgttatgcctacgggcaaagaaaacactctaaggaattttgcaaatggcaaagattaaaggtcaagttaagtggttcaacgaatccaaaggttttggcttcattactccggctgacggcagcaaagatgtgttcgtacacttctccgctatccagggcaatggtttcaaaactctggctgaaggccagaacgttgagttcgaaattcaggacggccagaaaggtccggctgctgttaacgtaacagctatctgatcgacaccactgatttgatgcgtttgtcgcgtcagcctcagatataaagcctcgctaaaagcggggctttttaattcaatatccttcaaaatgtgtctggatgcgctctcgttagcgatttgttgcaaaggcgcgatgttattagcattgttttttctggtttttccggccgtttcccgttaaatcaatcacctgaaaaatgattcggctggagatcaggtgaaaaagaaaagcgacggcgatacccgtaattttacacccatacgttttgcactactttgcactgccattctgctcagtatggcattgttgttagggcgggtggcatggctgcaaattgttacgccgtcgaaactggtgaaacaagaagatatgcgctcgcttcgtgaagtgaccacggcctctccacgcggcatgatcaccgacagagaagggcggcccttagcggtgagcgttccggttaatgctgtctgggccgatccgaaaactatcataagcaaaggcggcgttggctacaatgagcgctggcaggcgctggccagcgccttacatctgtctctcagtacgcttgcggaacgggtaaacagtaacccggcaggtcgttttatctacctcgcgcgccaggtttcaccccagcaagccgaatggatagataaactgaatctaccgggtattaacctgcgggaagagtcgcgccgtttttaccctgccggacatgtagcggccaatttgatcggctttaccaatatcgacgggcagggaatagaaggtattgaaaagagctttaacgcgcaactgacgggaaaaccgggctcccggctggtgcgtaaagataaatttggtcacgttattgagaacattacggaagtgaatccggttcctgctcatgaacttcagcttagcattgatgaacgtctgcaaacggttaccgaagatgcgctggataacgccgtcatctggaacaaagcggaatccggcgctgccgtattgattaacatcccaacgggtgaaattctctcgatggcgagctacccggatttcaacccgaacaaccgtgaaggcgcgcagttggacgattttcgtaaccgcgcgattagcgacactttcgaacccggttctactgtgaagccattggtcattatgactgcgttacagcagggtatcgtgcaaccggacagcgttatcgatacccatccttttactctcgatggacaccgtatccgcgacgtcggctactatccggaactgacattaaccggcattttgcaaaaatccagcgataccggcgtttctcacctttctctggcgatgccggtgcagaaattaatggatacttataaaagctttggtttcggcgtgcctaccggactgggtctcaccggagagagcagcgggttattaccgaaacgccgttactggagtgatttagatcgcgctaccttcgcttttggctatggattaatggtgacgccgctgcaactggcgcatgtttatgccacgattggcagctttggtatctaccgtccgttatcgatcaccaaagttgatccgcccgtgatcggcacgcgagtaatgccggaagaactggtgcacgaggtggaacatatgatggagagcgtcgcgttgcctggcggcggcggaacaaaagccgcagtaagagactaccgtattgcggtcaaaaccgggacggcgaaaaaaattggcgatgatggtaaatacgttgataagtatgtggcatataccgcaggcgtcgcgccggcaagtaaccccagatttgcgctggtggtggtgattaataatccacaaaatggggcttattatggcggtgcggtatctgcgcccgtattcagccagatcatgggcgatgtactgcggctggaaaatgttgagccagacggtatgccagccgattcagatcaccttctggtgatgcatggcagccacgttgcggttccgggctcgtaaaggattttcccggggcgcaattcgcgttacacttgcgccctttagcgccccagtccggagttgtcatgtcgtttacctgtccgctttgccatcaaccgcttacgcagattaatagcagcgttatatgtccacagcgccatcagtttgatgtggcgaaagagggctacatcaatctgctgccggtacagcataaacgttcgcgcgatccgggcgacagcgccgaaatgatgcaggcgaggagagcgtttcttgatgcaggccattatcagccgctgcgcgatgcggtgattaacctgttgcgcgagcggctggatcagtcggccacggcgattctggatattggctgcggcgaggggtattacactcatgcttttgccgaggcgttgccgggagttaccacgtttggactggacgttgctaaaacggcgatcaaagcggcggcgaagcgctattcgcaggtgaagttttgtgtggcgtcaagccatcgactgccctttgccgatgcgtcaatggatgcggtgatcagaatctacgctccgtgtaaggcgcaggaattggcgcgtgtggtgaaacctggtggttgggtcgttaccgccacgccggggccgcatcatctgatggaactaaaagggctcatttatgatgaggtgcgtttacatgcgccgtataccgagcagctcgacggattcacattgcagcagagtacccgccttgcttatcacatgcagctcaccgccgaagcggctgtagcactgttgcaaatgacgccatttgcctggcgcgccagaccagacgtgtgggaacaactggctgccagcgccggacttagctgccagacggatttcaaccttcatctctggcagcgtaaccgttaaccgtgaaaatgcgtccagaggatctggacgccaattcctatcagtacgaccccgccgagaatttcagcacgcttacccagcattgggccgataaagcgaccgatcatcattccgagggtggacatgataagcgtggcgcaaccgatagctaatgcggttgcgatgatgtttacctgcaaaaacgccagaccgacgccaaccgccatcgcatcgaggctggtcgcgatagccgtcgtgactaatagccaaaagctgtgacgacgtaacggtgtttcatcttcatcactaccgccgcggataccttcgatgatcatgcgtccgcccagaaagatcagcagaacaaaggctatccagtggttccattccagaacgaatttactcgccaatatccccagcccccagccgatcaacggggttagcgtttcaaccgcgccaaagataagaccggtacgcaacgcttctgagaatttgggtttatgtagggtggcgcctttgccaattgatgccgcgaaagcatccatcgacatgccgaaagcgagaagaacagtagcagtaaagtgcatgacagcgtcctgaccggggtatccattaaacacatcactgcccccagcaaacatgcatgtcgccattctgtgacgaaatacacagcagttgatgcgcctatggtctcgcctgaccagcggcggctggtccgtacgcgccacgttttgcaacgagtatgttgacacgtacatttccggagtctggaaatcggctactccctaattgacggcgcaacattaacatatttttagaatataaaacaacagcgataaaatattatttgccttctaattgaaaacgattttcatttagatttattcatcaataaaacgttaaattaaataacaattggtcaatagaaaatatagccttagctatattatgattcgaaataaaattcgaaaaacatagttgaggctatatcttaagctattgattttcaataagaagtttatatattttttccagatcgtcgatattgcgtacacggataagcaagcgtcgttgttctaattgcatcaccagtacgccgtcctccgataaattcatctctttaatacggttatattctatccagacattggcgaagaaaaagccacgttgtttaaagatgatccgtggcgtgcggatccagaatatataaaaccccattaacgccagcgcgcttaataaccatgtggtcatctgcgctccgtggctggttacgttgttataaataaggatggcgaccagcccaacgaagataacgctgtctatgcgaccgcggcggagcagggctatagaaagcagagtggggccattgcgacggggcatgatgaactgatcgtagagagcgtaagccaataatgcggcaataaagagaatcagcaccaggtccgtgatagtcatttatcctccagagaaataaaaaaacggggccgtttggccccggtagtgtacaacagccttactggcccagcagtcctacggagtagccggcgataccaatgacgaagaagcccacgataatccacagcgggttaactttcttacgcagcagccacatacaggcaaaggtcaacagtagcggaaccagacccggcatcagctggtcgagaatggtttgcacggtggtaacgcgtgtctgaccatcctgaccggtgatggtggagaccaccagcgggatattcacatgcgtccacttgttaaccaatgcccccatgacaaacaggccgaggattgacgccccctcagtcagtttttgcaggaagccgccgcccatatctttaacgatatcgacgcctttgcggtagccataagccacgccataataacgggtcgccagacgcaccaggttaaacaggatgaaaaacagcagcggaccaagcaggctgccgctcattgcaatacctgcgcccagcgccgcgaatactggacggacggtaccccagaagatagggtcgccgacgcctgccagcggtcccatcagaccgactttgataccgttgatagcaccatcgtcaatctctgcgccgttcgcacgcttttcttccattgccagcgttacgcccagtaccggcgccgcaacgtaaggatgagtgttaaagaactccaggtgacgcttaatcgcctgtttacgcgcgtcattattctccggatacaggcgacgaatcgccggcaccatagagaagcagaagcccagcgcttgcatacgttcgaagttccatgacccctggaacaggttagaacgaagaaatacgccgcgaatatcgctcggagtgagttttttctcggtggtagttttagtcatatcaaccatttcgctcacctgttagtccagttcgttatcgagatcgttattgccagcagccgctgcaggcgcgcccgctacacggttgtatttcgggctcagctggatgtaaagaatagccatcactgcgccgatgacacccagtgcgaccaggttgaagtttgtgaaagccgcggtgacgaaaccgaggtagaagaacggcatcaggtagcctgcgcgcatcatgttgataaccatcgcataaccaaccacgacgatcatgccgccggcgatgttcagaccgcctgtgacgacttcaggaatcgcattcagcattccctgtacttcgctggtgcctacggagatggcaacgataaccgccgggatggcgatacgcattgcctgcaggaacagagaagaaacgtgcagccaggagagcgccgtcaggttgccgttttcagccgccttgtccgccgcgtgctggaatgccacggtgatggtacgaacgataatggtcagtacctggcctgccgccgccagcggaatcgccagcgcgataccggcgccaatgctttgatgcccagcgatgaccagaacggtagagatgatggacgccagtgcggcatcaggcgcaacggcagcaccgatgttcatccagcccagagcgatcatttccagagtaccgccgatgataataccggttttcatgtcccccagaacggcgccgattaaggtacaggcgatcagcggacggtggaactgaaattcatcaagtaccgactccatacccgcgatacatgcgacgatgaacaccagcacaatctgaagagtggtaatctccattgtacttctcctattgctatcttaagtgtgaaagctaattaaatgccggcggttatttcgccactttggcaattaaatccatcattttcagtttcggatcggtggaaactttacgcacctcaagctcgatgccgcgctcgttgagctttttaaaggcttcgatatccttttcatcgacggaaacggcgttgttcacctgcgttttaccttgacgataggccataccgccaatgttcacggaggtgactttcacgccgccctcaacgatgcgctcgacgtcggtaggattggtaaacagaagcatcacgcgttcgccggcgtatttcgggttattgtagacgcgaatcatcttcgcgacgtcaaccacatgcgccgtaacgcccggcggcgcaacttgcgtcagcagcgttttacgtacggtatccgccgcgacttcatcgctcacaacaataatacggctgacattggtctctttggtccagcgggtagcgacctgaccgtgaatgaggcggtcatcaatacgggcaagcccgataaccatataatcattcgggcccatcggttttgccggcgtggccgcttttggcgcggcggcgaccggcgctggcgcggctttttctaccggtttcgctttcagcgcttttacgccttcacgaccggtttctaccgccagtgcgaccagctcgtcaaagctcggatcgtcgtcacgagccataaacgtttcgaccagcatcgggatgttgacgccggcaataacttcatagcgctctttatcgacgacaatgcggctggcagcattaaacggactgcctccccatgtatcaacgagaaatagcacgcctttactggtatcgagtttagccaactgagcgttgtacttttcgatcagcgtttcggcattttcgcctggaacgaaatcgatccagccgacgttttcctgctcgcctaacagcatttcggctgttttaagtaactgctctgcagcccaaccatgtgtgcctataacaatagcaatggtcacttgctacctcctttattattgtcaacacatcaacttgacagatgtattttttgaatcgccgtccgcaagcgaatcgattcagatgagggttacaacgaaaaacgcatgattttcgtgaattattttagatatcgaaaaaaatattttgtgtgatggagatctgtaattttgttttcgataatgagaaatttcgaagtgtaaaatatcctggttacatctctttgcaaaggaaggtaaatctttgccaaaaaccagttgtctctgttatgtttagcttccgtttaattagaatggggtatagggcagcagcccgttgtatggatcgtcaccgacgtcatttcactctttggccgttttgcgcctgtcaatctggcatatcttgccatagccttactttgtttattgcgttaccgcctgcatcctttgagatgttgtgggcgccgtttagtcattccttaagcaggagcttgtcatggaattattaatggatccctcaatttgggtgggtttactcacgctcgtcgtcctggaaattgtcctaggtatcgataacctggtctttatcgcgatcctcgccgataaattgccgccaaagcagcgtgacaaagcgcgtcttatcgggctctcgctggcgctgattatgcgtctggcgctgctgtccattatttcgtggctggtgaccttaacaaagtcgctctttactgtctgggattttaccttctccggccgcgatttaattatgctgctgggcggtatattcctgctgtttaaagcgaccaccgagctgcatgaacgtctggaaaaccgcgagcatgacaccggacacggtaaaggctatgcgagcttctgggtggtagtcacgcagattgtcatcctggatgcggtcttctcgctggacgccgtgattacggcggtaggtatggtaaaccatctgccggttatgatggcggcggtggtgattgcgatggcggtgatgctactggcgtcaaaaccgctgacccgttttgtcaaccagcatccgacggtggtggtgctctgtctgagtttcctgctgatgatcggcttgagcctggtggcggaaggatttggtttccatattccgaaaggctacctgtacgcggcaattggtttctcgatcgttatcgaggtgtttaaccagattgcgcgccgcaactttattcgtcatcagtccacgttgccgctgcgcgcgcgtactgcggacgctatcctgcgtctgatgggcggtaaacgtcaggcgagtatgcaacatgagacggatagcccggccgcgatatcggtgtcggaaggcgccttcgccgaagaagaacgctacatgattaacggcgtactgactctggcgtcgcgctccctgcgcggcattatgacgccgcgaggcgaaattagttgggtggatgcgaatctcagcgtagctgaaatccgtcagcagttactctcttctccgcatagcctgttcccggtatgtcggggcgagctggatgaaattatcggtatcgttcgggcgaaagagttgctggtggcgctggaagagggcgcggacgttgcggctatcgccgcctcttccccggcgatagtggtgccggaaacgcttgatcctatcaatctgttaggcgttttgcgtcgcgcgcgcggcagtttcgttatcgtcactaacgagttcggcgtggtgcaggggctggttacgccgctggatgtgctggaagcgattgccggtgagttcccggatgccgatgaaacgccggaaatcgttgccgatgccgagggctggatagtgaagggcggcaccgatcttcatgcgttacagcaggcgctggaagttgaccatctggtgaacgaagagggtgatattgcgacggtcgcggggttagtgatcgccgctaatggccatattcctcgtgtaggcgatgtcattgatgttccgcccctgcggatcaccattgtcgaggccaacgactaccgtgtcgatctggttcgaattgttaaagaacagcctgcccacgacgaagaggaataacgtcacacgcaggaatcaagtctatagatgcggcatcgcggacataatctgtccgttatgccgggcgggcggcggcgcgctgcccgccagccactgtggaaattcgctaatgggcatcggcttcgcatagagatagccctgtaacatttgcacgccatgctggcgcaaatgctgtgcctgcgtctggttttcgaccccttccgcaaccagttcaatattcagtctttgccccagcgcgataataatatcggtcaccgttgaattgaccgcatcggtaccgatgacggcggtgaagaatttatcgattttcaaaatatccggacgcagtttttccagccaggagagcgagctgtttcctgtgccaaaatcatcgatggctaacttcacgcctttacgatgcagctcgcgcatcaggcggtaatcaacgtcaagcaacgcgtcgcgttccgtgagctccagcaccagttgctgaacaggttccgcactaaaccagtactgattaagatccttgagaagcacgccgtgtcggaaatggcttgccgccacattgatgccgatatgaaactgatggttgatggggaagtagtgccgctgccgaatggtttccgcaatcacatagcgggtcagcggcgctatcaggttatgctcctcggtgataggaataaaaacatccggtgagatccagccctggcgcgggttattccagcgtaacaggatctcaacgccggtacactgctgcgtgcgggcattaagcaacggctgacaaaatagctcaaactcccgttcggcaagggccagattaatttcccaggaaaagctcattctgctggcggttgccagccaggcgatataaccgatcaacaggctaagcaatacggccagcggtaactgcgtcgggagatgtttgaacgccagtacgcctgccgacggcccgctgacgctgatagtaaaagggaaatgccgcgatgaaagctggtaacgctcttcatctttttttaattccggaagagtatcgaccacgccccgaccatataacaggtgccgtttgccgaccgtcaggctggcgctggtaatttgcggctgctgcggctcaagtagcatagtcgccagcaagtcaatattcacaatttccatcacgccatcctgtccatcggcagaggcgggataccactgaatgaggatcgggcttcccttgagtaacgattggtccgtggaaagtagcagcagatcgccagctgcgggaagatcgggctgaagctggcgtatgggagtattacgggcgccaaaaatgcttgagcagtagagaattccctcttttaccagcccgatagaacgaatggtttgcaggcgggcggcttgcttacgcaacggcagatgcgcggtcgcgcacggaagctcaagtaagggtagcagtatgtttcgtccgaccaggagaggatgcagcacattatccagcgcatcaacggcatgattcgcgaatgcaaccgtgcgatggtgatttaagttccgctccgaaataaatcggatgttcagcgtaagaatgagcgtgaccagtgcacaaatcgtgcaaacaatgaaacgattacggcgataatgattgatgatccgttgtgctgtttgcatgcgggccgcccaataagcgttggcgacaaaagccaaccgcgacacagcaagtgtagtggggaaacgtggagtcgacgaggaagagataaaaatttcgcccatccgtagcagatgggcgaagggaggggaaatggcgtttaatcacactggactttaatagccaacccgccgcgcgacgtttcgcggtatttggcgttcatgtcttttccggtctcgtacatcgtttcgatgactttatccagcgagacgcgcggcgcgctggttcgacgcatggccatacgcgcagcgttgatcgctttaaccgaagcaatggcgttacgctcgatacacggcacctgcacctgaccggcaaccgggtcgcaggtcagccccaggttatgctccatgccgatttcagcggcaacgcaaacctgttccgggctggcgcccaacagttcagcaaggcctgccgccgccatcgaacaggcgaccccgacttcgccctgacagccgacttccgcgccggaaatagacgcgttcatcttatacagcgcgccaatagcgcctgccgccaggaagtagcgggtgtaaatatccgggctgacagactcaataaaatggtcgtagtaagccagtaccgcaggaacgatgccgcacgcgccgttggttggcgccgtcacgacgcgaccgcctgcggcattctcttcgttcaccgccagagcaaacatgttcacccagtcaatgacgttcatcggatcgctggaaagcttatcgctggaaaccagcatacgacgcagcgcagaggcgcgacgcggtacgcgcagcggccccggcagaacgccttcggtattcataccgcgatcaatacaagcctgcatggtttgccagacgtgaccgaaatactcttcaatctctttcttgctatgcagcgccagttcgttttgcatcaccatgccggagagtgaaaggccggtgctgttgcaatactccagcatttctttcgccgatttaaacggataaggtacagtaacctcattcgtcgcttcctggccgaaatgcgcttcatcaacgataaagccgccgccgatggaatagtacgtcttgctataaatgaccgtgtcgtcatgccaggcgtggatctgcatcccgttttcatgcagcggcaaattgccgttgtgaaaacgcattccgtcatctttcgggaagtcgacttcgtgacgtccctgggccagtaacagacgctcgcgcgtttcgacgtcgcgaataaaaccggggatactatcaatatccacggtagcgggttcattacccgccagacccataataatggcgatatcggtatggtgacctttccccgtcagcgacagcgagccgtagacatcgacagcgacgcgggtaacgttatccagtaatcctttttcgactaggtcatcgacgaactgtttaccggccttcatcgggccaacagtgtgggaagaggagggaccaatccctaccttaaacatgtcgaataggctaatcacgataatactcctgacagggcaaccggggcttccggttacgatgttataactgcgcatagtgtaagagggaacgctggcatcagcttaactattcacatgaattaaactaatgaataaccgcgtttttactaatattgcgacagtaatctcaagtcgtgtcttgcgcgcgtaaagttaagtatatacacgttgcccttcaggctgcctctttgggggaggcgattgttaccgccttgaggcaacgtgaatggcgttgtgtacagtcagggctttacgccgatttgcagcgccagctcacgaagaatgtttgcggtcatgccccagacgaaataatgctcataccaggagagccatacgcggtgcgaattgccgcgacggtaaacatcaagcggatgatatcgacccagttgcaacgcttgcgccagcggcatttcaaacaccgcagacacttcgtcttcactggcgcgccaggggagatttggcggaataatgccgaccaccgaggtgacctgaaaaccggtcacgctgtctaccggcggtaaaacgccaatcacttccacggcttgcggcgggatggcgacttcctcctgcgcttcgcgaagcgctgcggcgataagcgaagcatcggtactgtccacggccccgccgggaaaggcgacctgtccggcgtgtttgcgcaaatgaatagcccgctgggtcaacagcagccccggctgggggcggcgaaccacagggatcagtacggcggcctgacgttgatttaacgtttcatgagtcatctgcgggcgcaaaagctgaaagcgcgataagaaatgatcgagcgtcagacggctggtatccacgtattagttctccagtgggtgcaggatacgattaactttatcaaaagtttcctgatattccgcttcttcgttgctatcggccacgataccgccgccggctgagcaatagagttggccctgcgttgccgtgacggtgcggatagtaatactggtatccatcttgccgcagaaactcagataaccgatgctaccgcaccaggcgttgcgtcgctgcggctccagttcgtcgataatttccattgcccgcactttaggcgcgccggtaatggagccgccggggaaagccgcgcgcagcagatcggtggcatgaagcgagtctggtaaacgggcagtaatggtgctaaccagatggtgaacggcaggaaatggttcgacgacgaacagttccggcactttcaccgaacctggtacggcgacccggccaatgtcgttacgcatcaaatcgacaatcatcaaattttcagcgcgatctttcattgaattagccagtttctgcgcctgctgacgatccgcctgcggatcgttaagccgtggaagcgtacctttgatcgggcgcgtctgaatatgaccgttctccagttggataaaacgctcgggagaaaggctcaatatggcgccgtcatgtaaacgaagaaaggcgctgaacggggcgcgatttgcgcggttaaggcgttcgaaagcctgccattcatcaccctcgtagctcgcctgaaaacgctgggaaagattgacctgatagcagtccccgctgtgcagccaggcctgcacctgacgaaacttctcgccatactcgcaacgcgtcatattggattgccaggccgaggtaagcctgaagggcgttcgggtcggcgcgcgctggccggtgagccagcgatatcgggcgtctgcatcgtgatagcttatcagcgacactacctgtttatggtgatcgacaatcagcgcccagtcgtaaaggccaatcgccatatcgggtaaagcgatatcgcgcgcggcagtatcgggcagaatttcgaaacgccgccctaaatcataaccaaacagacccagcgcgccgccctgaaagggtaagtcagggtcaggctgaggatgaaaaggcagcgcctccagttgagtctgcaaaacgtgtaacggatcgtcgagagtgacggtagtcgtgcgcgcagtacataccgtggtttcctgggcgcgcgtggtcagtgtggtgacaggatcggcgaccagaatatcaaaacggttatagggatgaatagcatcacctgaatgcagcagcatcgcccagggcaaatggtttacgggcgcaaaatagtgttcagcggcgtccggacgccagggtaaggtgataacagtgggagataacgtcttcatcattcctgactcgttacaacactactggcttaccgccgggtagcgtgaaataattagcgctaacaatttagcaggagttaatcatgtttgcaggtttaccttcactcagtcatgaacaacagcaaaaagccgtagaacgtatccaggaattgatgtcgcaaggtatgagtagcggagaagcgattgcccaggtggcaggcgaacttcgcgccaaccataccggcgaacggatagtggcgcgttttgaggatgaagacgaataaccggcttataccgccgcgacaatcttaatctcaactttatatttcgggttcatcaacccggcctgtacggtacagcgtaccggcgcatggcctgcgacgacccacgcatcccacgccttattcatggcggcaaaatccgctttatcgctcaggaaaatagtggcatccagaatacgtgacttactggagccctgtttttccagcaccgcatcaatttgcgccagagtattcgccgtttgctcaaaagcatcggcgtccaggttttccggcacgccgatataccacagcgtattattgtagatcaccacgtctgaccaacgatcttcggcatcaatacgcacgatagacatcacttattcctcatttgctttccatttgaatggctcaagactgccacaatgtggcgccgccgtcacctctgtaactggcgtaagcctttctaccctgacataatcccctgtgcaaattaacagggggcagtgtgacggacgattttgcagcagatggccaactggccaaagcgataaccggctttaaaccgcgcgaaccacagcgacaaatggcggttgccgtgacacaagcgattgaaaatgcgcagcctttggttgttgaagccggcaccggaaccgggaagacctatgcttacctcgctccggcgttgcgcgccgggaaaaaagtcattatttcgaccgggtcgaaagcgttgcaggatcaactctacagccgcgatctgccgacggtagcaaaagcgttggcgtttaccggtaagacggccctgttgaaaggacgttcaaactacctctgcctggagcgtctggaacaacaagcgctggcgggcggcgatttaccggtacaaacgttaagcgacgtgatattgctgcgctcctggtcaaatcagacgcgggatggcgatatcagcacctgcgtcagcgtggcggaggattcccaggcctggccgctggtcaccagtaccaacgacaactgccttggcagcgattgtccgctttacaaagagtgctttgtggtgaaagcgcgtaaaaaggcgatggacgcggatgtggtgattgtaaaccaccacctttttcttgcggatatggtggttaaagagagcgggtttggcgaacttatccctcaggctgaagtaatgatcttcgatgaagcccaccaactgcctgacatcgccagccagtatttcggacaatcgctctctagccgtcagttgctggatttagcaaaagacatcaccatcgcctaccggacggaactgaaagacactcaacagttgcaaaaatgcgccgatcgccttgcccagagcgcccaggattttcgtctgcaactgggggagcccggctaccggggaaatttgcgtgaactgttagccgactctcgtatccaacgggcatttttactgctggatgatacgctggagctttgttacgacgtggcgaaactgtcgctgggccgttcggcgctgctggatgcggcttttgaacgcgccacgctataccgttcacggctgaaacgcttaaaagagatcaatcagccgggatacagctactggtatgagtgcacctcgcgccatttcactctggcgctgacgccgctcaccgtggcggacaaattcaaagaggtgatggaacagaagcccggtagctggatttttacctcggccacgttgtcggtaaatgatgatctccaccactttaccgcccgtctgggaattgaacaggcagaatccatgctgttgcccagcccattcgactatacgcgccaggcgttactctgcgtaccgcgtaacctaccgcaaaccaaccagcccggcgcggcgcgacagttggcggctatgctcaggccgattatcgaagccaataacgggcgatgttttatgctgtgcacctcacacgccatgatgcgcgatctggcggagcagtttcgcgccaccatgacgctgccggtattgttgcaaggggaaaccagtaaaggccaactgttacagcaatttgttagcgccggcaacgcgctgctcgtcgccaccagcagcttctgggaaggggtggacgtgcgcggcgatacgttatctttggtgattatcgacaaattgccgtttacttccccggacgacccgctgttaaaagcgcgaatggaagactgtcgtttgcgcggtggcgatccgtttgatgaggttcaactgcccgatgcggtgattacgctgaagcagggagtggggcggctaattcgcgatgcggacgatcgcggggtgttagtgatttgtgataaccggctggtgatgcggccctatggcgccacgtttctcgccagcctgcctcctgcgccgcgcacgcgtgatatcgcccgtgccgttcgctttcttgcgattccatccgccgagtaatttgttacggagtatggtaagatgcgcgctattttattgatctaagcacgaaacctcatgcgaattctggctatcgataccgccacagaggcctgttctgtcgccctgtggaacaacggtactatcaatgctcactttgagctttgtccacgagaacacactcaacgtatcctgcccatggtgcaggagattctggccgccagcggcgcctcgctcaatgagatagatgcgctggcgtttgggcgcggtccgggcagctttaccggcgtgcgtatcggcattgggattgcgcaagggctggcgttaggggcaaatctgccgatgatcggtgtttcgacgcttgccacgatggcgcagggcgcatggcgtaaaactggcgcgacccgcgtactcgccgcgattgacgcgcggatgggcgaagtgtactgggcggaataccagcgtgatgcgcagggcgtctggcagggcgaagagacggaagcggtgctgaaaccggaacgggtcggcgagcggttgaaacagctttccggcgagtgggcgaccgtaggaacgggttggtccgcatggcccgatctggcgaaggagtgcggcctgacgcttcatgatggggaggtgtcgctcccggcagcggaagatatgttgcccatcgccagtcaaaagctggcggcaggagagaccgttgccgtggaacatgccgagccggtttatttgcgtaacgaagtggcgtggaagaaacttcccggcaaagaatgactctcactactattacccccatactttatgctgtggggtggaatagaggtcgagaaaaaggagtcgcatcatggcggttcaaaaacggttaataaaaggggcgctggcgtgcgcttttgcgcttatgctgagcggttgcgtgactatcccggatgccattaaaggttcgagtccgacgccgcagcaggatttggtgcgggtgatgaatgcgccgcagctctatatcgggcaagaggcgcgttttggcggcaaagttgtggcggtacaaaatcagcagggaaaaacccggcttgaaatcgcgaccgtaccgctcgacagcggcgcgcgtcctgttctgggcgaagcctcgcgcggcagaatttttgccgatgtgaacggttttctggacccggtggacttccgtggccagttagttaccgttgtcggcccgataaccggcacggttgacggtaaaatcggcaatacgccgtataaatttatgctgatgcaggctaccggctataaacgctggcatcttgttcagcaggtcgtcatgcctccacagccgatcgatccgtggttttacggcggacgcgcctggccttatggatatggcggttggggatggtataaccctggacccgcagaggttcagacgatagtaacagagtaaccctttgttttatcaataaaagaaacagcggctggtccgctgtttctgcattcatagagacataataaaaataaatagtgacgcgcttcgcaacctttcagttgcgtaattaataaactggtacgctgagttaatataatgttaacgacttgtttattgactggggttgtgatgacgacgaacactcattttagaggtgatgcattgaagaaggtttggcttaaccgttatcctgctgatgttccggcggagatcaaccctgaccgttatcaatccctggttgaactgtttgaacatgcggcgacgcgctatgccgatcagcctgcgttcgtcaatatgggggaggtaatgaccttccgtaaattagaagaacgtagtcgggcatttgcggcttatttacaacaagggctgggactcaaaaaaggcgaccgtgtggcgctgatgatgccaaacctgttgcagtatcctgtcgcgctatttggtattttacgcgccggcatgattgtggtgaacgttaacccgctttacacgccgcgcgaacttgagcatcagcttaacgatagcggcgcggcggcaatcattattgtttctaactttgcccatacgctggaaaaagtggtcgagaaaacgtcggtacagcacgttattctgacgcggatgggcgaccagctttctaccgccaaaggtacggttgttaactttgtcgtgaaatacatcaagcgtctggtgccaaaataccacttgccagatgcgatctcgtttcgcagcgcgctacagcatggctaccgtatgcagtatgtcaaacccgaggttgtcgctgaagatctggctttcctgcaatatactggcggtacgacgggcgtggcgaaaggcgcgatgttgacccaccgcaatatgctggcgaatctggagcaggtgaaagcgacctatgggccgctgctgcacccggggaaagagctggtagtgaccgcgctgccgctgtatcacatttttgccttaaccatgaactgtctgctttttatcgagctgggtgggcaaaacctgctgattaccaatccgcgtgatatccccggtctggtcaaggagctggcgaaatatccatttacggcgatgactggcgttaatacgctattcaacgccctgctcaataataaagagtttcaacagctggatttttcttcgctgcatctgtcagccggcggcgggatgccggtgcaaaacgtcgttgcggaacgttgggtaaagctgaccgggcaatacctgctggaaggctacgggctgaccgagtgcgccccgctggtgagcgtcaacccgcatgatattgattatcacagcggcagtatcggcctgccagtaccgtcaacagaagccaaactggtggatgacgatgacaacgaagtcgcgccgggtgaggccggagagctttgcgtgaaaggcccgcaggttatgctgggatactggcagcgtcctgacgcgacggatgaaatcattaaagatggctggctgcatacgggcgatattgcggttatggatgaagacggctttctgcggattgtcgatcgtaagaaagatatgattctggtttctggtttcaacgtttatccaaacgaaattgaagatgtggtgatgcagcattctggcgtgcaggaagtcgcggcggttggcgtgccttccggtagtagcggcgaagcggtgaagctttttgtggttaagaaagatccggcattgactgacgatgcgttgatcaccttctgccgtcgccatctgaccggatataaggtgcccaaacaggtcgagtttcgcgaggaattaccaaaatctaacgttgggaaaattttacgacgagaactgcgtgacgaagcccgtggcaaagtagacaataaagcctgagcgttaagtcagctaacgagagacgccggttaagccggcgttttttttggcgcgaaccaaagagaacacgatttgaattaccaaatgattgaaacggacgatgcgctggcgagcctgtgtgaggctgtccgcgcatgtccggctattgctttagatacggaatttgtccgtacccgcacctattacccgcagttaggattgatccagttatttgacggggcaaatgtcgccctgatcgatccgctcggcatcagcgactggtcgccgttaaaagcggtgttgcgcgatacgggaatcaccaaatttctgcacgcgggtagcgaagatctggaagtatttctgaatgcgtttggcgaactgccggaacctctgattgatacgcaaattctggcggcgttttgcgggcgtccgctgtcgtggggttttgcgtcgatggtagaagagtatacgggcgtggcgctggacaaaagcgagtctcgtaccgactggttagcccggcctttaagcgaacgtcagtgtgaatacgcggcggcggatgtctggtatctgttaccgatcgccaaaaagctgatgattgaaactgaagccgcaggatggctgcctgccgcgcttgatgaatgccgattgatgcagcagcgtcgtcaggagattcaggcgccggaagaagcatggcgggatatcaccaatgcctggcaactgcgtactcgccagttagcctgtctgcaacttttagctgactggcggctacgtaaggcgcgtgagcgcgatatggcggtgaactttgttgtgcgtgaagaaaacctgtgggcggtcgcgcgttatatgccgggcagtctcggtgagctggatagcctggggctttccggcagcgagattcgttttcacggcaagacgttgatatcgctggtggcgaaagcacaggcgctaccggaagaggcattgccggaacccctgttgaatctgatggacatgccgggctatcgcaaagcgtttaaggccatcaaagcgctagtggcggaggtgagcgcgtcgcatcacgtcagcggcgagctactggcatcgcgtcggcagattaatcagttgcttaactggcactggaaattaaaaccgcaaaatgggcaaccggaattgatttccggctggcgcgccgaactgatggcggagaagttaactcttctgttgcaggagtattcgctttaacgacggtaattgccgggaaaacggccagtgaaataaatgtccgtattcggaataatgtaaaaaaataaaaaaggcagattcttctgccttttttaatccaggaattttcccataaaagagcttattttgactcttcggcttccggcagcgttacgttaagttcaaggatggagatatcaccatctttttgctcaagctggacggtaaccatttccggatcgatttgtacgtatttacaaatgacctcaagaatatctttacgtaactgcggtaaataatgcggttcggcatcgctacggcgacgttccgcgacaatgatttgcaaccgctcttttgcaatattagcggtactctttttccgcgagagaaaaaaatccagtaatgccataatttatcctccgaacaggcgtttgaggaaacctttcttctcttcttcaatgaagcggaaaggacgttcttctcccaacagacgatctacggtatctgcataggctttacccgcatccgcagtggcgtcaagaatcaccggttcgccctggttcgatgcgcgcagtacggattgatcttccgggatcacaccgacgagtttaatacgcagaatctccagtacatcttccatgctgagcatgtcgcctttattgacgcggcctggattgtagcgcgtcaacaggagatattctttaatcggttcttcgccattttctgcgcgacgagatttcgatgccagaatacccagaatacggtccgagtcacggacagaagagacttccgggttggtcgtgatgatcgcttcatcggcaaaatagagcgccatcagcgccccggtttcgatacccgccggcgagtcgcaaacaatgaactcaaagtccattgctttcagtgagtccagtaccttagcgacgccttcgcgcgttagcgcgtctttatcccgggtctgcgacgccggaagaatgaagagattttcagtacgcttatctttgatcagcgcctgattcagtgtcgcatcgccctgaatgacgtttacaaaatcgtaaacgacacgacgttcgcaccccataatcagatcgaggttacgcagtccgatatcaaaatcaatgacgacagttttctttcccttctgggccaaacctgtagcgatggccgcgctggaggtggtcttgccaacgccccctttacccgaagtaacaacaataatgcgtgccataaaaattccttgttaaaaagggatcaattcaacggttgaactgtcaaagcgttgtctgctaaacgcaggcgcgccgctttgccataaaattctgccgggattttatcactcagccagtaaacacctgcgatagagaccagttctgccgtcagatgggtacaaaaaatttgcgcttcccgatcgccgctcgcccctgccagcgcgcgacctctcatcatgccatagacatggatattgccgtcagcgataagctctgcgccagcgctgacgtgacttgtaacaatcagatcacattgtggagcataaatgcgctgaccggaacgaaccggaacatcaattaatcgcgtttttgtgatgggattagcgttttgcggcggttcgctgggcgttgccggctcaacgggcgcaggccgaaccgctttctctttaccttcagtcagtaaaggaagacccatccgatcgatttctactttcaggctggcgtctttacagccgctcacgccgataatgcgtaagccggttgaggtcacgatcttatgcagttccggccagtttaccgggctttcaagaccgctaacgttaataacgacaggggcgtgttttaaaaacgcaggagcctgcgctattttgtcttctaacgcctgacgaataacctctggttccgcttcatgcaaatgaaccactgataaggtgaagctactgcctttaagctcgattggcgtgtttgacatcctggccttactcaatttgctatttatcatctccgatacggagtgatattccgaagtccagaaggcatgttatagtcagtattatattgaggcaagtcaccatcccgttaattcagagtaaaagtatgttttgtgtgatctatagaagtagcaagcgcgatcaaacctatttgtatgtcgaaaaaaaagacgatttttcgcgggtgcctgacgcgttgatgaaaggattcggtcagccgcagttagcgatgatgctgccgcttgatggacgtaaaaaattagtcaatgccgagctcgaaaaagtaaaacaggcgttaagcgagcagggctattatttacaattgccgccgccgccggaagatttgctgaaacaacatctttcttcggtgggacaaaatacgtcgcacgctgaccgttaaacggtattcggcgccgcgcctgaattccatcatgatcttaggggaaaatatgtatcaacatcgtaactggcaaggtgccttgcttgattacccggtaagtaaggtggtctgcgtgggcagtaattacgcaaatcacatcaaggagatgggcagcgcgacgccggaagaacccgtgctttttatcaagccggaaaccgcattgtgtgatattcgccagccgctggcgattccggcggatatgggcgctgttcatcatgaagttgagcttgccgtgctgattggcgcaacgctccgccaggcgaccgaagatcatgtacgtaaagcgatagccggttatggcgtggcgcttgatttaaccctgcgcgatattcaagggaaaatgaaaaaggccggacagccttgggaaaaagccaaaggtttcgataacgcatgtccgatttcaggcttcatccctgtcgcggccttctgcggcgatccgcaaaatacggttatcggacttaacgttaatggcgaggttcgccagcaagggtcgaccgcggatatgattcatcctattgtgccccttatcgcctatatgagccgctattttacgctcaaagccggggacgtggtgctaaccggcacgccggcaggcgtggggccattattaagcggcgatgagctggacattcgttttaatggcgaaacgttgtctactcgcgttctgtaaaatctgcttgccgccttcagcggcggtaaaacttgcatctgcaggccagactggttataaggtgcagctttaatgcaatggcggatactttaatgagcgatacacctttctggcaacgtaaaaccctggatgaaatgaccgatgccgagtgggagtcgctgtgcgatggctgcggtcaatgctgcctgcataagctgatggatgaagatacagatgaaatctacttcaccaacgtggcgtgcaggcaattaaatatcaaaacgtgccagtgccgtcattatgaacgccgttttgaatttgaacccgactgtatcaaactcactcgcgaaaacttgccagactttgaatggttgccgatgacctgcgcctaccgtttgttggcggaaggtaagcccttgccgacgtggcatccgctgcagactggatcgaaagccgctatgcatggcgagcgaatttctgtccgtcatatcgcggttaaagaatccgaagtacgggactggcaggatcatattttaaataaaccgtcgtgggcagaataagtcttcggcaaaacggctgattgtttacaattctttaatttacgctgggcggcccctgaaatcaggaattgcgtgcaaattccgtcacctggcgttatcactgccttctattcttccctgacgcgccttgtcgctgcgctcgcgcacgtatggcggcgactctatactttcaaagcagtatatcgctgcctatcctgaggagttaccccatgaataaccaaccgttgcgcgtttcaaaggatcagcccaggaagcctgataagacacccgaagacgaaggaaaaaatccaaagaaaaaccaaaagtagtgctgtagggtatctttaataactatggttcgttggaggctttatgtctgaacgtcctgatttagtcgatccattaccagaggatgagccgcttcctggtgaaaatattccggatacgccagagggagacgatcctctcgacccggatacccagaatgaggttgaagatcctcgtagatagcgtcttgtgctattaaccaaccgcctgatgcaccgtctgtgccaggcggttttttgcatcttctaaagcgaaacatcctgataatcctcagaaagatagcctataattttttgtacgttaaaatagtagcgcgtccatgacgacactgtcttattgcgcttagccgtttgcgagttcaaaggaggaaatcaatgaacagcgaagagttgacacataaagcagaagaggaaatcgcggcactcattagcaaaaaggtcgccgaactacggaagaaaaccgggcaagaggtttccgaaatagagttcgcgccgcgagaaacgatgaaagggcttgagggataccacgttaaaattaaactactctagcgtttaattagcgccattaatcacctggctactgggcgggacgccgcccagtggtaactggtttaccgatgtcaggcttttttctgttgatacatttcctcgccctgatggtcttcctctacccaaaaatgaatgttgaaccgcgcatcatcgctcagctctacccgatgccagtattgcggcggactggtggcgaattgcccggcattaatcaccactttcacttctggttctgtcgcggtttcattcgcaaagccatagtaggtcacggtgccttccatcacgcagagttgtccgaaaacgcctgccgctgtgttgtgatgagagagcagtgccgccggaacattctctttggtgtaaaagggggtagagcgtttaactttccagtttgccgggatgcgtaagtgggacataagacatctccctgatgtggtgattaaaagatgtatttaatatacaccttttaatcactggcaaacaacgcttcgggcaaaaaaacgctcccgaaggagcgtgtgtatcaacgaccgaacaggtcgcgttttttaggcttaaatgcctgagctatgacgacagctatcgctaccacaaggtaagcggcaaagatccccaacagccattgcggcatctccagcgttaaaaacgaccactggcgctcggcgcaatcaccggatgccacaaacacctgcggtagccatttacccaacggtaaccagtctggaaagcgcgccataaagtcacaggtcatgaacggcgagggatgcaactgaatcatcgtatgttcatacgccagttgtagaccccgccaggcgctgtaaatccagataaccattgccacgtatcgcagcggcgttttcggcgctattgcgccgaccagacccgcgcccatcacgccaaacagggcgcaacgttcgtaaatacatagcacgcaaggtttaagtaacatgacgtgctggaaccacagcgccaccatttccagcgccagggcggtaaacgccatcagtaaccatgcgccccgaccccgtgagcactggtttaaaaatcgcaacataataatttccctgcaacatgcgtagagaccgcagtgtaaaccaattcaattcgtgcgccactagcgggaaatgaaataatgtgtaattggataattatcaggcaaaaatcggagccgggcggtgtattgcccggccaaacgttacgaaagcgttgctaaccatcctgcctgagtcatccattcggtggccggcgcaagagtgaattcgacgcacagtagccctatcagggtcagtacgatagtgtacggtaacgccatccagaccatacggccataggagagacggattaacggcgccagcgcggaggtcagcaggaataagaatgccgcctgaccatttggcgtcgctaccgatggcaggttagtaccggtattgatggccacagctagcagctcaaactgttttaagctgattgcgccgttttccattgccgccttcgcttcgttgatataaatggtgccgacaaagacgttatctgagatggaagacaacaggccgttaaagagatagaacagcgttagctgtgcgtgttcagaggcttgcaagacgaactgaataatcggcgcgaaaagatgttgatcgataataaccgccacaatagagaagaaaacggttaacagcgcagtaaacggcagcgactcggtaaacgctttgccgatggcgtgttcatcggtgacacccgttaacgcggtggccagaataatgaccgacagaccaatcagtcccacctccgcgagatggagggcgagggcggtaaccagccagacgccaataaccgcctggactattagtttaattttatcctggcgggtgcgcttcttacggctttgatcgtcgaattgctgcaagacgtcgcggactttttcgggcaacgtttcgccatagccaaaccagcgcattttctcgaccagcatacaggttaacagtccacataccagtaccgggacggtgacaggcgacatccgcaaaaagaagtcgccgaaatgccagccagcagctttagcgatgatcaggttttgcggctccccgaccatggtcatgacgccgcccagcgccgtccccacgcctgcatgcatcatcagactacgcaagaatccgcggaattgctccagcaccgttttgtaatgcggatcgatatggctgtcgtccagcatatcgttctcttcgccgcgcgatgaggccacacgatggtaaatcccgtaaaaaccgacggcgacgctgatcaccaccgcaacgacggtaagcgcgtcaaggaaagccgacaagaatgcggcggcgacgcaaaaggccagcgacagaaccatcttcgagcggatactgagtaacagacgggtaaaaataaacagcaataactgcttcataaagtagatgcctgccaccataaacatcagcagcagcaagacttccaggttggcggcaacctcttcacgtacatgggcggcgctggtcatgccgatgataacggcttcaatggccagtaacccgccgggcagcagggggtaacactttaacgccatcgccagggtgaagataaactctgccaccagcagccaaccagcaacaaagggattagctaagaaaatgaatgggttaacaattaaaaagacaagtagtgccagtttgtaccagtcgggcgactggcctaaaaagttgcgccacatggcgcgaccccatgagatctccatgaaatttttccttacctagaaaaatgaaatagcgtttttatgtttaaacacagagagtagcgagcgcgacgaatgcaagcaagtccttaacgatattggcaggcgatatcagaaatggtgccttgatcccctttttcttcattgcgtccgctatcaggtgttacgcccgtctggtatgatgagtacaactatgttttgctgtgtaatggaaatctcactatggtcattaaggcgcagagccccgcgggtttcgcggaagagtatattattgaaagtatctggaataactgctttcctcctggcacgatcttaccggcagaacgagaactctccgaactgatcggcgtgacgcgcacgacattacgcgaggtgttacagcggctggcgcgagatggctggctgaccattcagcatggcaaaccgacaaaggttaataatttttgggaaacgtcagggctgaatatccttgaaacgctggcccgccttgatcatgaaagcgttccgcaactgatcgacaatttgttgtcggtgcgtaccaatatttctactatctttattcgtaccgcattgcgtcaacacccggataaggcgcaggaagtgctggccactgcccacgaagtggccgaccatgccgatgcattcgccgatctggactataacatctttcgtggtctggcatttgcctccggcaatcctatttacggcttgatcctgaacggcatgaaagggttatacacccgcattggtcgccactatttcgccaatccggaagcgcgcagtctggcactgggtttctatcataaattatcgtcgttatgcgagcagggcgcgcacgaccaggtgtatgaaacggtgcggcgttatgggcatgacagcggcgagatttggcatcggatgcagaaaaatctgcccggcgatttagcgattcagggacgataatcccgcgatgcccggtagacgcaaacactaccgggcagcatctcgattacagcgtgttcatgcgcggcggacaacgctccagcagttctacgctgccatcctcattttgttgctccagcatcacatcaaagccccataaccgatgcacatgtttcagcacctctttgcggcctttatccagcggcgcgcggttatgcgggatataacgcaacgtcagcgatctgtcgccgcgtaaatccacattccagacctgaatattcggctccaggttgctcaggttatactgtgacgacagttttgatcgaatctcccgataaccttcttcgttatgaatggcggagatctccagataattatgcctgtcatcatcaagtaccgtgaagaaacggaaatcacgcatcacttttggcgacaggaactgactgataaagctttcatctttaaaatcgcgcatggcgaagtgcagcgtttccagccagtcggaaccggcaatatccggaaaccagtatttatcttcatccgtgggcgactgacaaatacgtttgatatcctggaacatggcaaagccgagcgcataggggttaattccgctataccaggggctattatagggcggctgaaatacgacattggtatggctgtgtaaaaactccagcataaagcgttccgtcactttgccttcatcatacagatggttcaggatggtgtagtgccagaaggtcgcccagccctcgttcatgacctgcgtctgtttctgcggataaaaatactggctgactttacgcacgatgcgcagaatttcgcgctgccacggctcgagcaacggggcgtttttctccataaaatagagtaggttttcctgcggttcagcaggaaagcggcgtgcttcggcgacagttttttcttcctcgcgttttggcagcgtgcgccacagcatattcacctggctttgtagatactcttcccggcttttttgtcgcgctttctcttcctgcaacgagattttctgcgggcgcttatagcgatcgacgccgtaattcatcagcgcgtggcaggagtcgagcagtttttctacttcatccactccgtagcgttcttcacagcgggtaatgtaattccgggcgaaaatcaggtaatcgacgatagagctggcatccgtccagctccggaagagataattatttttaaaaaaggagttgtggccgtaacaggcgtgcgccatgaccagcgcctgcatggtgatggtgttctcttccatcaggtaggcaatgcagggattagagttgatcacaatttcataagccagtccttgttgaccatgcttatacagacgttccgtctcaatgaactttttgccaaacgaccagtgcggatagttgatcggcatcccgacgctggagtaggcgtccatcatctgttcggaagtgatgacttcaatttggtgcgggtaagtatccagttggtagagtttcgccacgcggtctatctctgccagataaacatccagcagatcaaatgtccagtcggggccatcgctcaaacgtgtggtgtccttgttcatggaatcaatcattgccattcgcgcaccctcattgttggcgacgctctctgtatggagcgcctcctttcaagcatagaacaccatgttaaaaaacgacttgatcgtgaaaacttttctttgcgatttcctccacattgaacggcaaaaaatcgggtattggcatcattttatgctgtatagccatgccgcgtagcaggagatcccaaaccaatgggatcgcttgtctttagggtatatgtgaagcacgtcaccataaaaaagtcatatgttgaataatattttcatctgagttatcaagatgtaatcagaagattgttcttttactattaacggagtggctatgcgagttgtcatcctggggagtggcgtagttggcgtgaccagcgcctggtacttgagtcaggcggggcatgatgtcaccgtcatcgatcgcgaatccggcccggcgcaagaaaccagcgcggcgaatgccggacaaatttcaccgggatatgcggcaccctgggcggcccctggcgtaccgctgaaggcgataaaatggatgttccagcgccatgcgccgctggcggtgcgtctggatggcaccccatttcaactgaagtggatgtggcaaatgctgcgtaactgcgatacccggcattatatggaaaataaaggccgcatggtgcgtctggcggaatatagtcgcgactgcctgaaaacgctacgcgccgcgaccggtatcgaatatgaaggccgccaggggggaacgctacaactcttccgcaccgcgcaacagtatgagaacgccacccgtgatatcgccgtgctggaagatgccggggtgccgtatcagctcctggaagccagccgactggcggaagttgaacccgctctggctgaggttgcgcataaattaaccggcgggctgcgcttaccgaatgatgaaaccggggactgtcagctctttacccagcgtctggcgcgcatggcggagcaggcgggcgtaacctttcgctttaatactcccgtggaaaaattactgtacgaaaatgatcagatttacggcgtgaaatgcgccgatgagatcattaaagcagatgcgtatgtcatggcgtttggatcgtattcgacggcgatgcttaaaggcattgttgatatcccggtgtatccgctgaaaggctattcattaaccatcccaatcgtcgagccagacggcgcgccggtatcgacgattcttgatgaaacctacaaaatcgctattacgcgttttgataagcgtattcgcgtggggggaatggcggaaatcgtgggctttaataccgacttactgcaaccgcgccgcgagacgctggagatggttgtgcgcgatctttttccgcgcggcggtcatattgagcaggccacattctggaccggcctgcgccccatgacgccggacggcacgccggtagtaggacgcacccgttataaaaatctgtggcttaatactggacacggcaccttaggctggacgatggcctgcggttcaggccagttgttaagcgatatcttgttgggtcgtacgccagcgataccctacgacgatctgagcgtggcgcgataccgttccgattttacgcccacccgcccgcaacgtttgcatagcgcgcataactgataaaggaagtgaaatgacccgccctatacaggccagccttgatttacaggtaatgaaacaaaatttggctattgtgcgccgggcggccccggaggcgcgcgtctggtcggtagtgaaagccaacgcctacggccacggtattgaacgcgtctggagcgcgctgggcgccacagatggtttcgctatgctcaaccttgaagaggcgattaccctgcgtgagcgcgggtggaaagggccgatattgatgctggaggggtttttccatgcgcaagacctggaggcgtatgacacttatcggctgaccacctgcatccacagtaactggcagttgaaagcgctgcaaaatgcgcggcttaacgcgccgctggatatctatgtcaaagtcaacagcggtatgaaccgactcggttttcagcctgagcgggcgcagaccgtctggcagcaattgcgggcaatgcgcaatgtcggtgaaatgaccctgatgtcacattttgctcaggccgatcatccggaaggtatcggggaggcgatgagacgtattgcgctggcgacagaaggcctgcagtgtgcatactcgttatcaaattcggcagcgacgctgtggcatccccaggcgcattatgactgggtcaggccgggcattattttgtacggcgcgtcgccgtcaggacagtggcgggatattgccgataccggactaaaacccgtgatgacgctgagtagcgaaattattggcgtgcagacgctgagcgcgggtgaaagagtaggctatggcggagggtattctgtgactcaggaacaacgcattggcatcgtcgcggcgggttatgccgatggctatccacgccatgcgccgaccgggacgcccgtgctggtggacggtatccgtaccagaacagtaggcaccgtttcaatggatatgctggcggtggatttgacgccgtgtccgcaggcgggaatcggcacgccggttgaattatggggcaaagaaattaaggtcgatgatgtcgcctctgcggcaggcacgctgggctatgggctactgtgcgccgtagcgccgcgcgtgccgtttgtgacaacgtaacctaactcaggctaaggcgtcgaccggtccaccgggggcgggtcgacgttgtccggcgaccttattctgcttcgtcttcggcgacgcgtaccccaatcttgcgtaccacgttatcttctttttcagctaccgtccaaatcatgccgccaaactccacctgatcgccaacgaccggcgcagcgcccagcagctgctgtatgatttcaccgagggtttgttgtttatcccggtattccgttccttcttccagcccgtagataagcgccacgtcggcgaatttcgcgttcgcttcgaggataaaatcgccaaagaaacgctgatctaacgaaaccggcggcgactggctaaacaatttgcccagcgctggcagatcgcgctcccggccaatcacgcagagtacgtcgccttcctgcaggcgagtgctacccgtggggtgaaacagttcattattgcgaaatagcgcggcaatgcgggtttcgttcggcatatgcaggtcgcgcaacgccgcgccgacgcaccatttgtcggcgctcaactgatagatgaattgttcccacggattatcaggatggatgtcaagccccacgcgcgatactggccagccaaccggaggcacgaccactttggctctcttcgccgcccatgacagcgatgttccctgcaggagcagcgacaccagtaccacaaagaaagcgacattaaagaacaggcgagcgttttcaagcccggccatcatcgggaaaacggcgagaataatcggcaccgcgccgcgcagtccgacccaactgatgaaaatgcgctcccgaagattgaagccgcgaaaaggcagcaggccggtaaataccgacaatgggcgggcgaagaaaatcatccagatagagagaataagcgcagggacggcaatcggccacagatcggaaggcgtcaccagcagtcccaggaccaggaacatggcgatctgcgccagccaggccagtccgtcaaagttttgcaggatgccgtaacggttgcgaatcggacggtttcctaacaggaatccgcacagatagaccgcgagaatgccgctgccttcaagcgcggtcgtcaaagcaaaaatcagaataccgccgctgagcgccagcatcggatacaggccgctgggcagagaaatacggttgatcatctgctgtagcaggtaaccgccgccgaggccaaaaacaataccgagaccgaactgctggataatatggacggcaaacatccagtccaggccggtttcatgtttctggatcatctcaattaatgtaatggtcaaaaaaacggccatcgggtcgttacttcccgattcgatctccagcgtggagcctacacgttcgtttagccctttgccgccaagcagagaaaagaccgctgcggcgtcagtggaaccgactatcgcgccgataagcagaccttcgataagatccagatgaaacagccaggcggccatcatacctgttaaccccgacgtgatcagtacgccgagcgtcgccagcgacagcgcggggcccagcgctacccggaaagagctggcctgggtgcgcatgccgccatcgagtaaaataatcgccagcgccaggttactgaccatataagcgaaaggataattatcgaaaggaataccgccaatgccatccacacccgctaacatcccaatggcgaggaaaatgaccagaatcgggatacccagtcgcgatgagaatgaacttaacaggatactgctggttacaaggatggaacctaaaataaatagactaataattgttgcagcatccaacgttttatatctcctgactcacacgacttcgtattatttaacattaacataataacggccagggcagcgttttacttagcctgtcggggactttttttacaattgcagcgtaggatgaccagataaagtgagttgagtcccctggcgcgtatttttaagcgttgcgtttgccccgatagggagcgtcaccgtacgctgttcatgcccgaagtcgagaccggtaatcagcggaacggacagacgggaacgtaaaaacgcgtagacgctctccagagaatagccggcgtcatactcgttgggcgccgcgccgctaaagctgccgagaacgatggcgctctgacggtttagaattccggcgtactccagttgcaaaagcatacgctccacccggaaaggatgctcattgacatcttccagcactaaaattcctttatcgatagtcggcatccagggcgtaccgataagggaaatcaacatcgccagatttccgccccataaggtgccctgtacgtcgcactgagggccgtcgccttgccactctacggtaaattgcgccttgcgtagcgccagccagaaatgttgctcggtgaacgtattcagcgtttcggcgccaaaatttgccgccagcataggaccgctaaaggtgatgacattggcctgcgccagtagtccagcctgaatcgccgtaaaatcgctatgaccgcaaatcagtaagggatcgcgctgttgccgggaggcgagcgcctgccagtcgatacgatccagcaagcggctggcgccatagccgccgcgaaccggcatgacgatcgtatccggcgaagttagcgaggccagcgaattaacatcggccagccgttccgcgtccgtaccggcaaaacgctgatagcggcgacgaatcacctcgtcattctccacctgatgacccgcgtcagtcaggcgctgaacgccgcgtaacgcggcctgttggttaatacagtagcccgagggggcgattaaatgaaacagagacatggtaattccttgctgacaatagaatgcaaatgtatatcatgccgcatatattaggcgatgtccctcgttgtgcgacgtttctggatgcgcaccagggaggcaacctaagtacctggccggggcggtataacctcttcggcagataagttacggctataaggatagatgacgtgaaattaagatggtttgcttttttggtagtaatactggctggctgtagctcaaaacaggattacaggaatccaccgtggaatgccgaagtgcctgtaaagcgtgcgatgcagtggatgcccatcagtgaaaaagccggggcggcatggggggttgatccacatttaatcaccgcgattatcgccattgaatccggcggcaaccctaacgcggtcagtaagtccaatgcgattggcctgatgcagttaaaggcgtcgacttccgggcgcgacgtttaccgtcgtatgggctggcgtggcgaaccgaccaccagcgagctgaaaaaccctgagcgtaacatctcaatgggcgcggcgtatctgagcattctggaaaatgggccgctggccggcatcaaagatccgcaggtgatgcaatatgcgctggtcgtctcttatgctaacggcgcaggcgcgttattgcgtactttttcatccgacaggaagaaggcgatagaaaaaattaacgatctggatgctgacgagttttttgaacatgttgttgataatcatcccgcgccgcaggcgccgcgctatatctggaagcttcagcaggcgctggacgccatgtagtttagcgtgaagattattctcgcactttattcgctctttctcgggcgtcgcgctcaagcgaaaaaataatccgctgcaactcccgctccaccgccgggctaacgttaaggaaacgaaagctcaggcggggagtggtgatcgtttcatttttcccatcaatcaccttacgctcgctgatggcgagaagctgggcgtcaacgtgaagaatcccccatggccccatgttcagttcaacctgcgaaaagcgtgcgccttcgattagtccgtcggggatggcggattccagtagcgcgcccatgccgcccagggaaagatcaaacaggcgaaaacgtaacgtacgggtgtccggtagcgtggtgacgccgtaataaggcggatacagcggcgcgccaatgcgaaaatactcccggcgctggacaaaccacagtgatgacggcaggggcgtgataaaggccggcagccgctgatattcacctgtaacgagttgcggcaacgtgaactcgacttttgcgccttgtgtttctgcgataatggctacctgcccggcgcgtaatacggcgctatttttatattcctggctgccgtaatccacgatgagtttttccggggctaccgccaaaattttactaatgaattgaccatgcgcccatgaaatacgcagtggaacctgatttttatttaaatcccgtagcacgcctaatatcgctaatggattttttttcaggaactgctcattgtaaccactcacacgaaataacccctgatacgcagactatcgttgggttatcggcatcagtagaaagaacttaatagcgataaataaatttttatgtccgcgagataaatcagtgttcagaaatgcgacgctcgactttgcctatacttaaaacgtttttactggaaagagggttcgcaaatgggaattatcgcctggattgtttttggtttgattgccggcgttatcgccaaattgcttatgccggggcgcgatggcgggggatttatcctgacctgtattctcggtatcgtcggggcggtcgttggcggatggctggcgacgatgtttggtattggcggcagtatcagcggctttaatctgcacagtttcctggtcgccgtggtgggcgcgattgtggtgctggtgattttccgccttctgcgacgcggctaaccgctgcagaacgtgtaagcgttgacccggtcagcgccgggtcaacctactataaacacgcgttactgcgtcgctgcagacggcgtttttgtcggcgttgcgcttaacgatgccggacgagtagacggtacgctatcgcacggtttttcctgcggacaaatcagatcgagcattttcagcgtcacgccgttgctccagccaaagccgtcctgaaggggatattcgccgccgccaccgccggttccggtactgctgacgtcatatttttcgaccagttttttctcgcgatcgtaggtgtgctgcacattggttaaaaagcgccaggtgacttccattgccacgtcatcctgcccataattttgcaatccttcggcagcgacccattgtaacggcgcccagccatttggcgcatcccactgctgtccgcttttaaccgaggtggtagccagcccgccaggctgtagcagatgcgcctgggccgccgctgccactttcgcggcgcgatctttcgcggcggcgtttacatagagcgggaacagcgcggcagcggtgagttggtcacggattttattgttctgcagatcgtagtcggcataccaaccctctttgttattccacagatgcatttcaatggctttttgccgcgcgttggccagcgcgtcatattgcgaggctttggcccgatcgcccgccgcagcgctggcgcgggcgagggttttctccagctgatacagcagagcgttaagatcgacagggacaatcgtggtggtacgaatggtactgagctgctgcggattatccatccagcgggagctgaaatcccagccggaggcggcagcagatcggaggtctcgatagatctccgttgccgggcggctggggttgcttttggcggtagcgatatcttcaacccaggattcagggcggggcgtatcccgatcgtcccagtagcggttgagaacgctgccgtcctccagtttgacgacgcgttggttttgttgccctggctgcaatgtctcaacgccctccatccagtaggcgtactctttttgcagttgcggcaggtattctttcagcgcatcgtcaccttcatgttgcaccagtaattcaaccataaacgcaaagaaaggcggctgtgaacgactcaggtagtaggtacggttgccgttaggaatatacccccaggcgtcaatttcgtaaccaaagttcgctaccatatccgccaccttatcccagtgcccgctttccgccagccccagcatcgtaaagtagctgtcccagtagtaaatctccctgaatcgcccacccggtacgacataggattcaggcaacggcaagagcgagtcccacttttcgacgtttttagttgaacgggtcagcaccggccacaggccatcaatatgttcacgcaatgattgcccggcaggcgggacatatttttcacccgctttcggcagggtgaagttaacatcaacaaaatgacgcaaatcgaagccggactagttccgctgcatacgataatccgcaagaatcatgagcggatcgctattaggtatggcgtcagcaaaggttttctgatcggggaagagttttgcattctggacatcattaaagagcgggccaagcaaaatatccggcggctgcggagtttcagtgtcggaagacgggtctgcggcagtcgccgaaaacgatgcaaacgtcagcagcgtccctgccagcgccagttttatggctttctgtagtagaacagaacggcgaatctctgggggtatcatcaagttatctccttagcagtgagccaaagccaacggcatttaccatgacaaaaccttagtctacgatgaccagatacgcgtgattgaaccgctattttgcgaacaaacagacattttattgagacagaatttatcggcgcgcgcgtggaaaacggggtatacagacaaaaaatccacgccgggacgtggattttagcgcaatgatttgtcgccttaacctggatagataccgcgatctttacgggccagcagaatgcgctcacaggcgacaatataggctgcggtgcgcagagaacaggatttctcagccgctttctcccagacatggacgatcgcgtcggtcatgattttgtccatgcgcgcgttgatctcttcttcgctccagaagaagctggccatatcttgtacccattcgaagtagctgacggttacgccgcctgcgttacagaccacgtcaggcaccacaaggataccacggctggccagaacatcatcagcatccggataggtcgggccgttagccccttccagcaccagcttacacgtcagggcttccgcgcgctgacgagttatctggccttcaagcgccgccgggatcagaatatccatctccagacgccagaacgcatcgctggcgatagtttccgcgcccgggaaaccggctatctgtttgtgttctgtctgccatgccgtgagcgccttcatgtcaataccggtggcgttaaacagcgtcgcggtatgatcctgaatcgccacgacacgggcgccagcgcctgcaaacagacgcgcggcttcgctgccgacgttaccaaaaccctgaaccgcaacgcgagcgccttcaacggcgatattcgcccgacgcgcggcttccagcccgctgacgaaaacgccgcgccccgtcgccttttcacgacccagcgaaccgccaagatggataggcttaccggtgacgacgccagtgaccgtcgtgccatgattcatggaatacgtatccatcatccaggccatcactttaccgttggtgccgacatccggcgcaggaatatctttctgcggcccgatgataatgccgatctcgctggtatagcggcgggtcaaacgctccagttcaccttccgacagcgagaacggatcgacgcggatgccgcctttggcgccgccgtacggcagattcagcgcggcacatttgatggtcatccatgctgacagggccatcacttcattgagatcaacgtcaggatggtagcgaacaccgcctttacccggacctcgggagaggttgtgctgcacgcgatatccttcgaaatgacgaatagtgccatcatccatttgtaccggaatatcgacgatcagagcgcgttttgggtggcgcagagtatccacctagggggataactcgcccagataaggggccacacgctcgatttgttgcaggtaggtattccaggcagatgtgctgctatctgaagcgtaagataacttatccatgataaaccttagtgataaaagtaatatgttctttaattgaccgtggtacatagtagatcacaccatgtagcgataaatttaacactttttttaaacaattaactcagatcaaaaatggcaggcagttggattttcgttatgattttggatgagaagtggttaactatccgctataagaggtgatatatcgctaattatgcaattaattgcttaaatatgcgtgatatgtgcaaggcggctatttgtcataattatgacgcacctctaaaagtaaagattatgataacgacatgtatcaatgttatgtcgtcctgtcggcggggaaacgtcttcgccaggcgcgtaaaaagataaaaataaccggagtcagacggctctgaccccggtttacctctttattgttgacgcgactcaagccacaccagcaccagcgtcgacagtgagcacatcagcagaatgccgacaaaccacagtaaataccacatcgctctcgctccctaataaagttcatgatcgttgcggcggagggtctccaggttgatacgccccaacattttgtaatagctccacagcgtatagagcagtacgattggcagaaaaatcagcacaatcaccagcatgatttcgagcgtcatctggctggaggtgctgtcccacaccgtcaggctggagagaggactaacactcgacggcatcacaaaaggaaatagcgttatgccggcggtaaagatgacgcaggcctgggtcagggaagcgaacagaaatccacgaatagtctgaccgcgaaggcaggcatagaaagccagaatcggcaggatcataccgagcaacgggatgatgagcagtagcggcgagcgtataaagtggttcatccatgcgccagggagtatcgccacgccttttaagagcggattggaagggccgttggcatcctgcgtgagtaagacaaagccatcaacgccggcccacagccagtaaccggccagcaggaagcagatcacgatcagcagcgcgctgtggcgggtggccgacagagcccgttgacgaataacgccctccgttttcaactgtaaccagacgcctccttgcataatcaccaacgacagactcaataatccacacagtagggcaaagggcgagagtaactgtcagaaggtgccaaaatagtcaacatgaagctgcggcgtgaaggcaaacggcacgcctaaaaacaggttgccgaacgcgatgccgaatacaacggggggcaccaggctgccgataaccagaccggtatcccacagcgcgcgccagcgggcattggcgattttaccccgataatcaaaggccagcgggcgaaggaagagggcacacagcaccaggatcatcgccacataaaaaccggaaaacgcggcggcatagacccgtggccaggcggcgaataatgccccgcccgcgagaatcaaccatacctggtttccttcccagtgggcgccgacgctattgatcaatacccggcgttcgtcatcgttgcgcgctatcagcgggagcaggcaaccgacacccatatcaaacccgtcagttaccataaatgccactaggatgacgccgatcagcagccaccaaatgaaccgcaacgtttcataatccaacatgattgtctcctttatccctgttgttgcgcttgttgttgatgttgcatggcgctcggcccaagacgcgcgtacttctgcatcagatagacttccgcgattaaaaacagggtgtaaagtccgaggataagccccattgagaaggccaactggcccggcgtcagcgcggagtgagcgtaccaggtcggcagaatgtcctgaatcgcccagggctgacggccaaactccgtcataaaccaaccggcttcaatggcaatccacggtaacggcaggctccacagcgtcatacgcaatacccagcgatgctggtcgatacgcattcgcagcgtctgtatcaacgcaatcaacatcaccactaacagcagcgaaccgcagccgaccataatacggaaactccagaacaccggcgccacctgaggaatagcgccacgctgggccgcacgatactgctccggcgtcacatggttcatatccggggcatatttcgccagcagaatgccgtaccccagatcgccctcaacggcgtgaaacgcattcagtacctgcggcgagcgattgccttgcgctatctcctgcatgagtagccaggcctcccggccacgcttcaggcgcggcagagcgtcgtccatcaggttttttaaccccggaaccggcgtatccagcgaatgggtggccagaatacccagcagagcagggatcttcacggcaaatgcattacgctcctgttcctgctgcggccaggcaatcagatgaaacggcgcgggcgcgggttcggtttgccattcgccttccatcgccgccagtttcaccggctgaatttgggcgacctcgtaggccgaactgtcgcccagttgcagggttcccagaatggccagggtgccgaatactgagccgatagcaaacgagcgcaaggccacctcacgctcgcggccacgtagcagatacaaggcgctgatagacataataaacatggcgccggtgacataaccggacatgacggtatggacgaatttcacctggctcaccgggttaaagaccagatcgctgaagctgctcatttccatccgtaacgtatcgatgttgaaatgagcgccggtaggatactgcatccagccattggcattcagaatccataatgctgaaatattggagccgaaggccaccagccaggtgaccagcaggtgttggtatttattcagccgctgccagccgaaaaagaacaggccgacaaaagtggattcgagaaagaaggccagtaacgcttccatcgccagcggcgcgccgaagatatcgcccacatagttggaatagagcgaccagttagtcccgaactgaaactccatggtcaggccgatagccacaccgagagcaaaattgatcccgaagagcttgccccagaaacgcgtcatatcgcggtagacggttttccccgtcaccacatagatcgtctccatgacggccagcaaaaaaatcagcccaagcgtaagaggaacaaataaaaagtgatacagcgcggtcagcgcaaactgccagcgcgataagtcaatgacatcccacatgctaactcctgtaggcagaaagagagtaaaaagctaatcaataccggacaccggtgacgttcctgttgagagcgctagcgcgtctccagccatcggcagacttcatccaggcgctggcgcgaatcggccagatcttccggggccgccagtaccagctccggcaaaggacaaatctcatagctatcgagcaacggccctttaagggcgtccagacagcgcacatgccagagatggcgcaatgctgtggcgttgatttggctttcgccatacccggagatgcgaatctggatgttcccgtgtccgcataaacgcgccagaaaaagacgatcggcctcgctgagcggcagttgggtcaaattgatgctgtgaggttgcaacgccggatcgcgtacgtgcgccaataactcatgggccagcggcagtccattcatcaggccagcgacaggcggaggcagcagagagtcgtcaggcagcgtatcggcagtcgccgcttgccacaatgtcaggggcgcgctacccgcttccagacgatccgtcagcagacgtcggttatgcagatggcgtacccgccacaggccgcagaagatggtctcctggatctcgctttcactcccgtccggatgctgaatgcgtaccgagacttcgccttcgcccaatagcgtattgaggaatgagagatcatcggcattcaggggagataactcccatcccagcacgtcgccgacttccgggatgcgccgggcaagctgacctcgcagatcggtcaacaatgccatcaccgccgggctgtgagcgcagcgttccagcgccgccatacttgggtcgccattgacctgacaggtgagcggtaggggattcatcgagaaactggcgtcatcaggctgcgtgcctggccccagcagatgaaaaaaggcgttgctcattgtgctgtctcctgcgctgcgggagtgtcaaccatcgaacgcatcagcgtgagcagttcagcccagggatgaatgccgctgagcgcgccgcgtagctcgccgtctgtaaaaaccaacgtcgccggaaaccgacgtacattaaagcgatcgccgatagcttcgctttgttcaaggtcggccaccgccacctgccagtcaaactgcgggaactcacgcaggagttcggcaatcatcaccgggttatcgctgacttccggcgtacgccgcggatcgctacttaacaggatgacgccatctccaatccgtttgatccagtcgtctaccgtggaagcctctaccggttgccatccacgggttaacaggcgttgccatagcgcagagaacggggtgtcattcgccacttcttttgccctccagacgtgtctgatactgacgtatgcgcactccctcataattttccatcgacaggcatttatagttcaggcagcgtgcgacctcatttgcctgcggtacgatcccccaggcggccagttgcgccagggcggcctgttctgccgccggtagctggctgcgagctatttcgctcaggctaccgccgtagtcgtccagtagcgccggttgcaggccgaccagcgcaatgtgacagggcagatgtccgcggatgtcggccagcgccagaacttcggaaaaactgttttgatgcaggctcatttttttggcgctgagatacgcggggattttctcgccggcataggttcgcaggctgcccggcgccaggccgtaatcgatcgcgtcaaggagcaggagatggctggcttgctcaacataacctaacaggtttagcccttgcgtaccgccgtccacaatttctacctcttcaggccagtgatatcgggcatacaaacgctccgcgacccggataccgaatccttcatcggcccacagcaggtttcctaatcccatcaccactacacgttgcgcattcatgagggctccttgtcgtgcggtttggggaatttgtggctgcgatagccattgatcatggtggagatcaccgtatcgtcggacataatgtcttcccggatagcgaggtaaacgtgcccgacgatgaaggcggcgatcagccacatgcccagtcggtgccagctgtgaatatcgatggagttgccgccggtccagtagaaaaattcaaccacatagcggaacggcgcaaagatggcatactggctatgctcgccaaacagagcgaaaccggtgaggatcataaataccgataacaggaaatagccgaacatcgcggcctgcgcgataggattatgtccgatgtcgctccccggttttttctccagaaacagataccagcggaccacggagaaagcgccttgccaccaactgcgacgccagaccgggacgataaacagctctcgcgaatagcggttgccgacacaggcccaataaattcgccccagcagtaacacgataaagatcatcgcggcggcaaagtggatcagccggatatagcccatgtaaaacagataggtcgcctcgccactcaccgacggcagcggtcggccaatgaagtagcctgttaccatcagtaccaacatgcaggccaccgttagccagtgccacaggcgtaccggcgcttcaaacacatagtggctgacggcagtatcacgcgcctccccgacgcgtggagatagctttccagtcatcgttcttttccttaacgcttagcgtacctggacggcaatcagttcgctgccgtcgtcgccgagcacgtgggttgaacaggcgaggcaggggtcgaagctgtgcagcgtcctcaggatttctaacggttggtcgggaatcgccatttgcgttcccatcaatgccgcttcataggcgccgatctgttttttaggatcgcgtgggctggcgttccaggtggtggggactacgcactgatagagttcaatcttctgatcgcggattgacgcccagtgtcccaacgctccacgaggcgcttcggtaaaaccgatgccgcggcagtgctgcggccaactggccggttcccatttctcggtattggcggtggccaggtcgccgtttttcaggttggtcataagcctgtcgaaaaaatactgcagcttaccgacggcccattgcgcttcgtgcgcgcggcataaaatacggccaagcgtagactggataccggagagcggcagtttaagggcagacatcatgcgatctaccgactctatggtggcggcatcccctttgtgatacgcgataagcgttcgggcaagcgggccgacttccatggcatgaccccgccagcgcggcgctttaatccaggagtagcgttcctgctcgttgagctgctggatatgcgtatcgctgcctttgacatcacccgggttgtaccagggatcggtaatgccgtcaaaaggatgacggcccagccgatcgtccggatagcggtaccaggcatgatccacaaactcctgtatctgctgcggatcggccaaatctaccggcatgacatttttaaaatcgccattgaccaccgcgccgcccggcattaacaggctttgctggctgaagtcgttggcaatgtccggaaatgcgccgtagctcagcacgcatttatccgacagaccggtgccaatttgactccatgctttattgaactggccgatagccagcgcgtccggaaccatcacgttgttaatgaagtcggcggtgcgggtgatgatcgactgcaccaggttgaggcgctccatattgatagccccgaccgcgccgctttgatcgagattgatcgcgcacggcatcccgccgacgatccagttaggatgggggttcttaccgccaaatatggtatggattttgacgatctcgcgctggaagtcgagggcttcaagatagtgggcaaaacccatcagattagcctctggcgacagtttgtactgtggatgtccccaatagccgttacggaatatcccaagctggccgccatcgacaaatttcttcaatcgattttgtacgtcaaagaagtagcccggcgatgacatcggccaggcggaaaggctttgcgccagctgcgaggtggcgcgtggatcggctttcagcgcattcagaacatcaatccagtccatgccggctaactgataaaaatggaccaaatgatcgtggcaccacaacgtagccagcatgatgttacgtataatattggcgttatccggtacctggataccaatcgcatcttcgatagcgtacaccgacgccagagcatgtaccccggtacagacaccacaaatacgttcaacaaacgcccaggcgtcacgtgggtcacggccttgcagaatgatctccagcccgcggaacatcgtgccgcaggaaacggcattggtaatgacgttttgctcatcaatgttcacttcgcagcgcatatgcccttcgatgcgggtaatcgggtccacgatcagacgacggccggcgtcgttaacggtataaccctgggtttgatactggttactcatgcctgtttatcctcattgtccggctgttgttcggcttgcgctaactgttgtttgtggcgtttacgttggttgagcgcgctggcgacagcgtgaccgccaacgcccgcagcgaccacgcccagcgcggtcagccccaccgtatcggcggttgaatgggtacccatctggggaatatccaccacgcggctataaaacgagccgcgatcccagaaaccattttctgaacatcccagacatccgtgaccggactggataggaaaggagacgccgtcattccagcgtgtggaggagcaggcgttataggtggttggccctttacagcccatcttgtacaggcagtatcccttgcgggcggcgtcatcatcccagctctcgacaaattcaccggcatcaaaatgggcgcgacggtagcatttatcgtggatacgctgaccatagaacatcagtggacggcccatgcgatcgagttccggcagacgatcaaacgtcaccatataggtgataatggcgctcatgacatccgggattggtggacatccagggactttcacgatcggcttgtcggtgatcactttatcgataggcgttgcctgggtcggattggggcgggcggcctagacgcaaccccaggaggcgcagtttccccaggcgataatagcgctggcgcccgcggcggctttcttcagtttttcaataaacgggcggccgccgctgatacagaacattccttgctctcctaacggcggattgccttccaccgccagaatgtatttcccggcgtagcgagtggtaatatcgtcaaagacttcttcggcctgtgcgccggcggcggccatcagggtgtcgtcataatcgagggaaatcagcgagaggatcacatctttggctagcgggtgcgaggaacggataaaggattcggtacagcaggtgcattccagtccatgaatccagaccaccggaatccgcggtttattctccagcgcccaggcgatctttggcgtcattccggcgcccagtcccagcgatgtggcggcaaggctacagaatttgagaaagctgcgtcgggtcactcccttacgacgcatggcttgataaaaggtctcctcgttattcataacgcgtattttttctcctttttgcaccacgctccgccaggggcataaggcgcttttgcgggtccgttgacgttccgccagcaaggtaaatcattgtgttacgcgcgagcgcggaaacgagcccgattcactttgcaccgacgtataccgccagaaataatgtgaaaaaagcgtatcggattaacgataagaaacaatgtgaagtgtgtgggtatagcttatagcggtatatttatacccattatcggtttttcggcgaaagggccgtggcggggaagcgcggttgagtttgttccgggatgaggttttcagtgagcaacctcaagtggatttagcctggtctcgccatttcagggatacgtaagttgatgcaaaaggagggaggatttgatgtcatcgttaaaagaagcatacttcgtgatgatttttatataaaatgatggtgctggttttaaaggaatgcaaaaaagagactgtttgaaagagggcgtcccatgaaaaataacatcagatttgacttatccgattatttgattcatttttttcgggacgttgatttagagaccggtagccatatttatttacctgaacactgtggttttaataatcagcaccatgcatgttccattgatgctaaatatttacttagattatctttacgcagtcataaaattttctcgtcctggtcataccgaaatggacaacgaaccgtatatggtgactccccggtggtatgctttacagatatgccgattgcagcttatttagaaactggtgttcgccgattagaacgaaatgaaaatattggtttatatgcaatcgttttacctaaagagcaaatgtttaattatggggcaaggccagtcatatatgggttggatcagcataacaatgctcgatgctcgcaaggcagatatggggaacgtattcttgatgaaacggctcttcctctgattgaacaatatagatatgttacttatgttccaggtaagattgactggacacatgaacgcgaatggcgatggccatatcgtggcgatattaaaaaattccttaatcatattaaagagtatggtattccggaaaacattgaaagtaccccagggtttgattttagatcaagcgaaataagtggtgcgggaataatcgtcccgtttgcagaagatatccctaccgtagctcacgatattttaactttaattgaccggggtgtcattggaagaaatactttcaaattcattatagctgtagagagtttacaatcatggacccagctctcggaaccgggtgcgttactatcctatattaatgacaatactttcgaatttgaatctttttttgatttatctgcatctaaagtaaaaaattatgctgactctatcaatgattatgtaagtgaattatattcaaaaaaagattttttaaatgataattatgcaatggaatttggaaatgcctgggtctggattcatgataaccaatcccaggtggtacgggcgttactgcaggctggaatgatcaaggttaataaagaagggcggtacttattagatgttaatttggcttctgttgattggccattaagaagaaaagaggctttcgcaagtcatgttgcgggatggctcaaacatcgttttgatatcgaagcgggaaggtattccgttcggggaaaagatgattatgatgcgatcccaagttatgagacgccgctaaaggatcagcatcctttttataatcatacagtgaatgtcgactggtaattaagaaaaaaacttaccctgttagctctgcgttaattgagcctgtcagtatgagttgagatattatgaaataaaaaatccacgcggctgcgtggattttatgagtttctttgcctcttatgagattcagcaaaacctcataagacaacaatttttacttagacgttgaacaggaagttcattatatcgccatctttaacgatataatctttgccttccgctcgcatcttaccggcttctttcgcgccttgttcacctttataggtaataaagtcgtcaaaggcgatagtttgagcgcggataaagcctttttcgaagtcggtatggattttacctgctgcttgcggcgcggttgcgccaaccggaatggtccatgcgcgaacttctttcaccccggcggtgaagtaggtctggaggttcagcaggcgataaccagcgcgaataacgcggttcagccccggttcttccagacccagttcagccataaattcgtcacgctcgtcatcatccagctcagcaatatcagcttcgacggcggcacacaccggaaccacgaccgaaccttctttcgcggcgatttcgcgaacctggtccagatacgggttattttcaaaaccgtcttcattgacgttagcgatatacattgtcggcttcagcgtcaggaagcttaaataacggatagccgctttatcttcgtccgtcaggtccagcgaacgcagcatccccgcttcggccaggtgcggcaggcatttttccagcgcggccagttccgctttggcgtctttatcgccgcctttggctttcttctgtacgcgatggatcgcgcgctcgcaggtatcgaggtcagccagcgccagctcggtattgataacatcaatatcttctgccggatttactttacccgccacgtggatgatattgtcgttctcaaagcagcgaaccacgtgaccgatagcttcggtttcacggatattggtcaggaactggttacccaacccttcgcctttggatgcgccttttaccagaccggcgatatccacgaactccatcgtggttggtagaatgcgttgcggtttaacaatctcagccaactggtccagacgcggatcgggcatcggcacgacaccggtattcggttcgatagtgcagaacggaaagtttgccgcttcaataccggcttttgtcagcgcgttgaacagggtggatttcccgacgttgggcagaccgacgataccgcatttgaatcccatgatttaactcaccttaatatcttaataatcaacctgttatagaaaacagattgcagaaatggaaataacttcgcctattatacacggcgtgcggcaaaaatgccgcacatcactggttattgcgccttaaaggtatgcaaacggcttgttgctttggccagaccctctttgaaccacaattccgtacagcgcgccgcttcgtcaatggcctcatcaattaatttttgttcagaaacagggggtttacccagcacgaaaccaacaactttatttttatcgcctggatgaccaattccaacgcgtaagcggtgaaagttgggattattgcccagcttgctgatgatgtctttcagaccattgtggccgccgtggccgccgccaagtttaaatttcgcgacgcccggcgggagatccagctcgtcgtgagcgaccagaatttcgtccggctgaatacggtaaaaactggccattgcgccaactgctttaccactgaggttcatgaacgtggtgggtaccagcaggcgaacatcttccccttccagcgtgatgcgtgaggtatagccaaagaatttaggctcttcacgcaacggcgcgcgcaggcgctccgccagtaaatcgacgtaccatgcgcctgcattgtgtcgcgtcgcggcatattccgcgccgggattcgccagaccaacaatcaatttaattgccacgttttttgtcctgagtagatccatgactggcgcgtagtttactgtctgtctgcccgcttgacaaaacacagcgacactctgaagtaaattaaataattgccagcattgattattaaaaatgtaaactgttcagagtgttatttgtaaagttttgttaaatgaaactttacatttgtgatcgcacccgcacttacaaatggaagtgttgtctatactttacacataaagtttagggggatttcctaaaaacaacccaaaagttccggaggtgacatatgaaacgcaaaaacgcttcgttattcggtaacgtgctgatggggttggggctggtcgtgatggttgtcggcgtgggttactctattttaaaccaactgccgcagtttaatttgccgcaattttttgcgcatggcgcaatactgagcatttttgtcggtgcagttctttggctggcgggggctcgtgtaggggggcatgagcaggtgagcgacaaatattagtgggtacgtcactatgacaaacgttgccgccgtagcgacaatcgtcgtcatagctaaccggttcaggcccggtaagcgttatcgccaccgggcattgtccattaactgagtaaatccgctaacgcctccgtcctgttcgggaagaaggtcagacgtccaggaatgggtttgataccggcacgcgccattgtgcgcagcggttggaactccaggttactgatacgcaattcgcaaccctccggcagacgcttcacaaaacgctgaaaagcatcaagcccgcctgcatccagcactggtactgcgtcccatttcagaacgacgatacgtttgcccttaatacgtgactcaaggtcggtaaacagcccttccgccgcggcgaaaaagagcggaccgataacacgcagcaccagcacatcttcaggcacatcgacattgaccggcgcaagtcgagtcattcgcgcaatacggcgcataaacagcagggaagcaaggacaatccccacgctgatggcgatgaccatatcaaacagaaccgttaatgacatgcacagcagcataacgataatgtcatctttcggcgcatggcgtaacagatccaccactttatgggcttcactcatattccatgccaccatcagcagtagcgccgccatcgcggaaagcggcagccaggagagtagcggggctaagaccagtagcgccagaatgaccagaatagcgtgaattaccgccgagacgggagaggtcgcgccagcgcggacgttggcggcagagcgggcaatcgcggcggtggcggtgatgccgccaaagaacggcgcgaccatattccccagcccctggccgataagttcgctgttagctttatgtttggtgccggtcatgccgtccagcacgacggcgcagagcaatgattcgattgcccccagcattgccatcgagaaagccgctggcagcagcgcgcgcagtgaatcccagcttagcgtaaaatcggagccaggaaggctccacggcagcatcagttgcggcaggagctgcgggatgccgttgccctgagtgccgtcagccagaacgtaatggaactgtgagccgatagtcgccacattgccgcccagcagattaacaatccccattacggcgcaaccggccagcagcgcgggaaggtgtcccggcagacgaataccgagacgcggccagaaaatcagcgttcccagcgttaccacgccaatggcggcatcgccaatattgacggtgggcaacgccataaacagcgcgccgactttctgcaaatagtgctctggcacatgggccatctgcagaccaagaaaatctttaatctgcatggtaccgatggtaataccaatccctgaggtaaaacccaacgtgaccgacaccgggatatattcaatcaatcgccccagtctcgccaggccgaaaaggatcaggaagaagcccgacatcagcgtggcgaccagtaggcccgccagaccaaactgttgcgacaccggatacaaaatcaccacaaacgcggcggtagggccggaaacgctaaagcgcgagccgccggttagcgcgatcacgatcccggcgacagcggaggtatagaggccatactgcggcgcaacgccactgccaattgccagcgccatcgccagcgggatagcaataatcccgacggtgatcccggctatcacatcacgggtgaaccgggaggcggtatatttttctttccagcaagcatcgatgagagcgcggaaaggcatcacatgtgaggaaaataatttgttcacaataatgtttcatccatgagcgcatcatctgtcaactaaatggcaggtgaaggaggcataagtcatataaaagggtgttacagacaaaaaaacccgccgcagcgggtttcagatccgggttcgatcaatgctcgaacatggcggaaatcgattcttcgttgctgatacggcgaatcgcttcggccagcatacctgacagggtcaaagtacgcacgttcggcagcgctttgatttcgtcggtcagcggaatggtgtcacagacaacgacttcgtcaataacggagttgcgcaggttgtttgccgcattgcctgagaagatcgggtgcgtcgcgtaggcaaacacgcgtttagcgccacgttctttcaatgcttctgctgctttgcacagagtaccgccggtatcgatcatatcatcaaccagcacgcagtcacggccagcgacgtcgccgatgatgtgcatcacctgagaaacgttcgcgcgcggacgacgtttatcaatgatagccatatcggtatcgttcagcagcttagcgatagcgcgggcacgaaccacgccgccaatatccggggaaaccacgattgggttatccagattcagttgcagcatatcttcgagcaggattgggctaccgaacacgttatcaaccggaacgtcaaagaagccctggatctgttcagcatgcagatctacggtgagaacgcggtcaacgccgacgctggacaggaagtcagcgacaacttttgcggtaatcggcacacgggcggaacgtacgcgacggtcctgacgtgcatagccaaagtaggggataacggcggtgatacgacctgcggaagcacgacgcagggcatcaaccataacgaccaattccatcaggttgtcgttggttggggcacaagtggactggatgatgaaaatatcaccaccgcgtacattttcgttgatttgtacgctgacttcgccgtcgctaaagcgacctacggcggcgtcgccgagagaagtgtacaggcggttggcaatacgttgtgctagttccggggtggcgttaccagcaaaaagcttcatatcaggcacgagaagaacctcaggcatgcgtccattggtggaaagaatctgccgaaaactgtgcgggccaggcaaaatcctatccaggcggtgtattaaagagcgcgatgcaacgtctggaacaaggtgacgttgtcaccgaagctcagcttgcccggcttactcgtcttcattcacgtttcatgtgcgctggtatcaatgcctcacaccggtcaaatacggcatatatgaccggcgactcgtcatttcgccatcttcctgaaacccgaatgcgttagagtaactctcgatgcaatggggaaaggttaacacccttcgccacaaaagcattgagccattccggggcttgctcaagcacctggcgagcacaagactctgtatcgaattcagcaaagacacaggcccctgtcccagtcaggcgcgacggcgcgtattctaacagccaggaaagcgccgcatcaacctcgcgaaaacgttttcttgcgataacctcgcaatcattgctgaattcacattttagtaacgtatctattgacctttttggcgtattacgcggcaattgaggatctttaaagataactggcgtcggaatgcttacgccagggtgcgcgaccagataccatttttccggcggattcaccggcgttaatatttcgcctacgccttcggcaaacgcggcgtggccacgaacaaagaccgggacgtcggcgccgagcgtcaggccgagcgtcgccagttcatcaatggaaagcccgcattgccaaagatgattgagcgccaccagaacggtcgcggcgttagacgagccgccacccagaccgccgcccatgggaaggcgcttctcaatgctgatatccgcgccgcttccggcgggcaggcgtccactctccgaggcgactttcatcaacagccgcgcggcgcggacgatcagattgtcttcattttcaacgccggttaccggcgttaataaatggatttcgccatcgtgacgcggttcgatgtggagtgtgtcgccataatccagaaactgaaacagcgtctgcagcgtgtggtagccgtctgcacgctgtccggtgatatataaaaacagatttaattttgccggagaaggccaatgggtcatcatttcacaatccagttatccattttcagcttaatgcgctgactgccatctgaaagctccatattggctggcatggcaggctgcgttttgctgtcatagccaccgtaaaccactttccagtttttaccatcctggtggtagttcacttcgctcaggcggtactggtcgtccagtttgtagtcggtggcatcgccaggcagaccgaggatccactgccgcaggctgtttaacggaatcggcatcccggtgagtttgccgatcatctcttcggcgtcatcggcggtataacgctggcctttgttatccaccaactggacgttgcccggctgggcgttaagctccagctcggtgctgcccagcgggttggtaagcagcaggcggtagcgatcctgtccggtctgttgccagaagaagcgcgcatagactttctgatcatctgagatgtaagcaaaggcgccgcgcgtctggtattgattcagatgacgcacctcttgctgatgctggcgccactgaggggaatccgggctcttgcccgggcctttatgcccaggaagcgtacaggcggtgagaaccaggcttgctaacggcagtagacgaatcaggcgaaaatcgggcagggtcatagtgatgacgaatccttgtgatacggtgcaataattgcctgaaggcgttacgcttatcaggcctgaaaactgaaccggcaagctgtaaaaacgttcgcgccgcgattcggcaaatttttgctatcggttacagttatagcctttaatgctagcgccgcctggtgacatcgtctactttcaagttgtcttaaatcatcaaattagcgagcgctgccaattactccaaaagggggctctctcttttattgaccacgcgcatcctgtatgatgcaagcagactaaccatatcaacgctggtactactcccgcagacatgacccttttagcactcggtattaaccataaaacggcacctgtatcgctgcgagaacgcgtaacgttttcgccggacacgcttgatcaggcgctggacagcctgcttgcgcagccaatggtgcagggcggggtcgtgctgtcaacctgtaaccgtacagagctgtatttgagcgtggaagagcaggataacctgcaagaagcgctgatccgctggttatgcgattaccataacctgaacgaggacgatctgcgcaacagtctgtactggcatcaggacaatgacgccgtcagccacctgatgcgcgtcgccagcggtctggattcactggtgctgggcgaaccgcaaatcctcggtcaggtgaaaaaagcgtttgcggattcgcaaaaaggccaccttaacgccagcgcgctggagcgaatgtttcagaagtctttttccgtcgccaagcgagtgcggactgaaaccgatatcggcgccagcgccgtctccgtcgcgtttgccgcctgtacgctcgcccgccaaatctttgaatcgctctcgacggtcactgtactgttagttggcgcgggcgaaactattgaactggtggcgcgtcacctgcgcgagcataaagtacaaaagatgattatcgccaaccgaacccgcgagcgcgcgcaagccctggcggatgaggttggcgctgaggttatctcgctcagcgatatcgacgcccgcttgcaggatgccgatattatcatcagttcgaccgccagcccgctgccgattatcggtaaaggcatggtggagcgcgcattaaaaagccgtcgcaaccagccgatgctgctggtggatatcgccgtaccgcgcgacgttgagccggaagtcggcaaactggcgaacgcttatctttatagcgtcgatgatttacagagcatcatttcgcataatctggcgcagcgtcaggctgcggcggtggaagcggaaacgattgttgagcaggaagccagcgagtttatggcctggctacgcgcccagggggccagcgagaccattcgggaataccgtagtcagtcggagcagattcgtgacgaactgactaccaaagcgctgtcggcccttcaacagggcggtgatgcgcaagccatcttgcaggatctggcatggaaactgaccaaccgcctgattcatgcgccaacgaaatcacttcaacaggctgcccgtgacggggatgacgaacgcctgaatattctgcgcgacagcctcgggctggagtagcagcacacaccacacttttttacagggtgaatttacgcctatgaagccttctatcgttgccaaactggaagccctgcacgaacgccatgaggaagttcaggcgttgctgggcgatgcgggaattatcgccgaccaggaccgctttcgcgcattgtcgcgcgaatatgcgcaattaagcgacgtttctcgctgttttacggactggcaacaggttcaggacgatatcgagacggctcagatgatgctcgacgatcctgaaatgcgggaaatggcgcaggaagaactgcgcgaagcgaaagaaaaaagcgaacaactggagcaacagttacaggtactgctgctgccgaaagatccggacgatgaacgaaacgcgttccttgaggttcgcgccggcactggcggcgacgaagccgcgctgtttgccggcgatctgttccgcatgtacagccgttatgccgaagcgcgccgctggcgcgtggagatcatgagcatgagcgaaggcgagcatggcggttataaagagatcatcgccaaaatcagcggcgacggcgtgtatggccgactgaaatttgagtccggcggacaccgcgtacagcgtgttccggcgaccgagtcgcaggggcgtatccatacctccgcctgtaccgtcgccgtgatgccggagctgccggaagccgagctgccggatattaacccggcggatctgcgcattgatacgtttcgttcttccggcgcgggcggtcagcacgttaacaccaccgactccgctatccgtattacccacttgccgaccggcatcgtggtggaatgccaggacgagcgttcgcagcataaaaacaaagcgaaagcgctctcggtgctcggggcgcgcattcacgccgccgaaacggcaaaacgccagcaggccgaggcgtcaacgcgccgcaacctgcttggcagcggcgatcgcagcgatcgtaaccggacctataatttcccgcaggggcgcgtgaccgatcatcgtattaatctgacgttatatcgccttgatgaaacgatggaaggtaagctggatatgctgattgagccgattgttcaggaacaccaggctgacctgttagccgcgttgtccgagcaggaataatggattttcagcactggctacatgaggcggtaaaccagctccgggacagcgacagcccccggcgcgacgccgagatcctgcttgagtacgttacgggcaagaggcggacgtatatcatggcctttggcgaaacgccgcttaccgatgtccagcaacaacagctcgcggagctgctgcagcggcgtaaacagggcgaacccattgcgtacctgacgggcttacgcgaattttggtcgctgccgctcttcgtttctcccgccacgctaatcccgcgcccggataccgaatgtctggttgaacaggcgttggcgcgattgccggtcaaaacctgtcgtattctggatttaggcaccggaaccggcgcgattgcgctggcgctggcctgcgagcgaccggattgcgaggtgactgcggtcgatcgtatgcctgatgcggttgcgctggcgatacgcaacgcggaacatttggctatccggaatgtgcgtatactgcaaagttgttggttcagcgcactatcggggcagcagttcgacatgattgtcagcaatccgccctacattgacgcgcaggacccgcaccttagcgaaggcgatgtacgctttgaaccgcgctcagcgttggtggcggacgaaaacggtatggcggatcttacgcatattatcgataatgcccgccagatgttaacgcccggcggcttcctgctgctggaacacggttggcggcagggcgaagcggtaagagcggctttcaggcggtctggttacacggatgtagaaacgtgtcgtgattatggtggcaatgaacgcgtggcctgcgggcgttttacgccatgacaattgcaatgttgctcacgcttcatcttatttgtgttgcgctctccgtcagtttgtttgtcgctcgttactggtggcgctattgcggccatgcgttggccgccgcgcgctggacacgaatcgtgcctcccgtcatagataccctgttactgcttagcggtattgggttaatcgttaaaacgcacatcctgccattcacggagtcgggctcatggctgactgaaaaactgtttggcgttatcatctacatcgttttgggttttattgcgcttgattatcgtcaggcgcgcagccagcaggcgcgttttatcgctttcccgctggcgctggtggtgctgtacatcatcattaaactcgccaccacaaaaataccgttactggggtaagtcatgaggtcgttagctgatttcgaatttaacaatgcgccgctgtgtgatggcatgatcctggcatcagagatgattcgcctggattttcccacgcagtttgtctacgacgaactggaacgtctggtcagtctggcgcaggaagaaattagccagctcctgtctcaggatgagcaactggaaaaattgctggcacttttttacggcgagtgggggttcacggattcccgcggcgtctaccgtctttctgatgctttatggctcgataaagtcctgaaaaaacgccaggggagcgctgtatcgttgggcgctattttattatggatagcaaaccgtcttgatttgccgttggtgcccgttatcttcccaacgcagctgattttgcgtattgaatcgctggaaggagaaatgtggctgattaacccgttcaacggtgaaacgcttgatgaacataccctcgaagtctggttaaaaggcaatattagtccggtcgccgagttgtttaacgaagatttggacgaagcggataacgccgaagtgattcgtaagctactggatacgctgaaatcctcgctgatggaggaacggcaaatggagctggcgctgcgcgttagcgaagcattgttgcaatttaacccggaagatccttacgaaatccgtgaccgcgggttgatctacgcgcagcttgagtgtgaacacgttgcgctgactgatttaagctacttcgttgaacagtgtccggaagacccgatcagcgaaatgattcgtgcgcagatcaacaccattgcgcacaagcaaattgttctacattaattaaccgacattttacctataagtgtaaggcgatcctatgaaacaaaaagtggttaacattggcgacattaaggtggcaaatgacctgccgtttgtgctgtttggcggtatgaacgtgctggagtcacgcgatctggcaatgcgcatttgtgagcactacgtaaccgttacccagaagctgggtattccttacgtgttcaaggcctcttttgataaagccaaccgttcctctattcactcttaccgtgggccgggtctggaagaagggatgaaaatcttccaggaactcaaacagacatttggcgtaaaagtgatcactgacgtccatgaagccagccaggcgcagcctgtggctgatgtggttgacgtgattcagctcccggcgtttttggcgcgccagaccgacctggtggaagcgatggcgaaaaccggcgctgtgattaacgtgaaaaagccgcagtttgtaagcccgggtcagatgggcaatatcgtggataagttccatgagggcggtaacgataaggtgattctgtgcgatcgcggcgcgaacttcggttatgacaacctggtggtggatatgctgggctttagcgtgatgaaaaaggtctccggcaactcgccggtgattttcgacgttacccatgcgctgcaatgccgcgacccatttggcgctgcctcgggcggtcgtcgtggtcaggtgaccgagctggcgcgcgccggtatggctgtcggtctggcgggcctgttcctggagtcgcatccggacccggctaacgcgaagtgcgacggtccttccgcgctgccgctggcgaaactggagcagttcctgacccagataaaagcgattgatgatttggtgaaaagcttcgacgagctggataccgagaactgattgcggtttttagcttgtgtaggccggataagatactatccggcttttttgtctatggaaaacccccagctaggctgggggttccggaaagctttcagctttaagccagttattaaaaccccttttgatttgttaaaacatcttgcggtctggcgactgcaaaagttcaacaagaaatcaaaagggggtcccaatgggggacgaaaagagcttagcgcacacccgatggaactgtaaatatcacatagttttcgcgcccaaataccgaagacaagcgttctatggagagaagcgtagggcagtaggcagcatattaagaaaattgtgtgaatggaaaaacgtacgaattctggaagcggaatgttgtgcagatcatattcacatgcttctggagatcccgccgaagatgagtgtgtcgagtttcatgggatatctgaagggtaaaagtagtctgatgctttacgagcagtttggggatctaaaattcaaatacaggaacagggagttctggtgcagagggtactatgtcgatacggtgggtaagaatacggcgaagatacaggactacataaagcaccagcttgaagaggataaaatgggtgagcaattatcgatcccgtatccgggcagcccgtttacgggccgtaagtaacgaagtttgatgcaaatgtcagatcgtatgcgcctgttagggcgcggctggtaagagagccttacaggcgcatcagaaaaacctccggctatgccggaggatatttattattagtattcgaacggttatcaaaataatttatcaaaacgtcctcaattcagaccgcaatagtagtccatcctttaccccgatcgtcatgataacctgagaccccctgaaagctgatagttaccgattttgattgtggtggttttctttatgatgtgtggtttggctattttttgaaagtgccttaccagatttattgttattatcaggggattatttcaataaaaggtgatgatttattgcctgcaatagtgggtagattaagcattttatgaaattattagtgtctttatttgcacttctacaagactgttaagaggtgttgaaatatcagcctggtaaagaatacgtcagcgaaagtgaatgctatattagtcataaaaattcaggagacatatgctcaaacctatcttctacagtggaagtgtgaaggttccggaatgtctggaaacagataaggaaaaaaatgtcggacgtactcctctgtcttcagacattcagcaaattaaaaatgttgttgaagatattccgccatttccagaaagcagagcggtgggaggttctgtaagcgcagcgtacaggctttcttttgacgaagtgttttgcggtctcagcaatgaagagcgtaaaaaggtgtatggtcgcctttttggaaaacaagtacttgcgcatattcattccaggtgtcagcgcgacgctgacataataagagaaaaagcgctcaggcggataagccgtgagtgtggtaccgaaatagattgcgctctcttactaaataagatggtggatattttacaaaatgcccggctgacaataaattttaatgcagcaaaaattgactttgtctctctcttaaaaaataaagaatatctgaactcttatgcattaggttgcagaccaggagatttacctgcttataatgtcgggcgtgattcagttgaaactaaagcatttgaactggagaagcttgcagattcaccttatgccccatatggtcagacaggcggtttttccgtagcatatactcccaacagtaaaacttttagccctacaagcagaccaatttatgctgcactggactttctgaacggtgaaaatggaggtgccagcgcctatgggaaatcattttttgaattaaatgataatgtaaaaacaaattgtacattctcaccttttgatatctacggccacagatttggcctggatactagtaaattatctacattttgccatatggagaacctgattgcatcctgtcaaaatgatttttttggttataattgctttaagagtttggttaaaatggctaagggcgaaaaatttttagctcattctaattatggtacaggctatgaagggaattatatagaggctcatattcatggtgatgtatgtttattcagagatataaagcacgtttatttgtctttgcaagaaaactcttactcggaaagtcaactatatgattatgcaaaacaaataaaccaggcgcttaatagagactgcataatattatattgacaagcttattatcaggctctttaaaagagctttaaatgatcatgagcacatacttcttaaggtaggcagtaactgcttttatatttattatagcaggaccgctctggcagatacctgtgtggcacctcagtatggcctgaaaaatagaggaatatggaccagcagaagcgcctgctggctacttttcacttaaatcgctggaattcaccggcgctacagatgaagcgaccttaacagtcatcaggtgtcctgcattaccacaggagtgatttactggctatcgatattcctgctcatcaggtttttacgccatctacgcacatttattctgctataagttgaaatactgcaaaaaatattaaggcttattattttttctttaagcaaattttcgttcaacaaacttggatgcgggaatgtgtgaaatatcatttctttatactagaactcagcgacctacagctcacaactttattagatcctcttcctgaatatattacttttctggcagttatcaacaataggctgactaaattgccggacactttgcctggagggtacagacagattacgcgggtaggatcactacaccgggaaaagattgccagttaatgggatgtcgtccatgtttcagttggaggataatgatttatttccccctctttgaccctacaatagtgatctgatagttatcctgaacgttcttacagagggcgggcttgttaaataatcatcaagttattaatgagttatgtcctgctttgctgaaaataaaaatcagtagacagacgacggcgaacaatatgagccggaagtgcctgtgttattactgtggcgtgaattctgtaactgataaagtaggtgtgcttattatcagtaatgaaattttttatatatgtattattactattcacaggtaatttgattgtttgttgtgagtaacattgtgttgaagtaaaccatgatagactggactgtgatgtggtgagatataatgaatttgtgttttattaattattttaaacgtacaggagagtagtatgtatatgagtaagtatgtacctgtttatacattattaattctcatttattcttttaatgccagcgctgagtggacaggagataatacgaacgcctactactcagacgaagttatcagtgaattacatgttggtcagatagatactagtccttatttttgcataaaaacggttaaagctaacggtagcggtacaccagttgttgcatgtgcggtatcaaagcagagcatatgggcgccctcctttaaagaacttcttgatcaggcaagatatttttacagtacagggcaatccgtaaggattcatgttcaaaaaaatatctggacctatccgctttttgttaataccttttcagcaaatgctcttgtgggactatcatcgtgcagtgcgacacaatgctttggacccaagtaagaggggagaagaaataatgaaaaagttaatattcttaaccttatctatagttagctttaataactatgctgtagattttgtgtatcgtgtggactcaaccccgccggacgttatttttcgcgatgggttttcactacttgggtataaccgtaactttcagcaatttattagtggaaggtcatgtagtggtggaagtagtgacagtcgctatattgcaacaacctcaagtgttaatcaaacatatgctatagccagagcgtactattctcgctcaacattcaaaggtaatttatacagatatcagattcgtgcagataataatttctacagcttgctcccatccatcacctatctggaaacgcaaggtggtcactttaatgcttatgaaaaaacgatgatgcgattgcaaagagagtatgtttccacattatctattttacccgagaatattcaaaaggccgtggcgctagtttatgatagcgcaaccggtctagtaaaggatggtgtaagcacaatgaatgccagttatttaggtttaagcactacgtctaatcctggtgtgataccttttcttccggaaccgcagacgtatacccaacaacgaattgatgcattcggcccattaataagttcatgcttttcaataggtagcgtatgtcattcacatcgagggcaaagagctgacgtatacaacatgtctttttatgatgcaagacctgtaatagaacttatactttctaaataaatgaaacttacctatgttgcctattaaattaaacagcccgtttattagttgcctggttaatattgtttattaagttggctatccacttaaatataaatgtttatatacttcgataagttttttatcagattcattgcattaccaatcatagcattcaggtacgtattttattaatattagaaggagtcattatgactaaagatgaaatctttgcagctatccttagtagagaaggcggttacgttgatcaccctgacgacaggggggggccaacgcattggggtataaccctgacgacggcccgggctaatggctatatgggggatatgcggaatcttacccgtaatcaagcattaaaaatccttgaggcagattattggtatggtccacgacttgatcaggttgccattatctctcactctattgcagctgagctttgtgatactggtgtgaacatgggaccctcaatcccgattaagtacttccagcgttggcttaatgtttttaatgatcagcaaaaaatttatccggatttgatagcagatggtcagattgggccacggacgctttcggcactaacattttttctctctcaccggagagatgagggcgaaatgatacttatccgggcattgaattgtagtcagggacaacgctatctggagttagctgaaaagcgccaggcgaatgaatcatttgtttatggatggataaaggaacgggtaagattgtaattcccttacttaccactatagcggtttgtgatgatagcatataatgatatattcacacagagaactggtgaaagccactaagtctcattattactatattaaggcgtcaggtttttctatagttctttgtgtgttaaaaacgagaaattaattatgttgtatggtatgagaatgatagtatttccagccaaatattcttacggctaaatacattattatccttttccattttggcacgcccagaactttcatcccatccaggaatatgagatcggactcttttctgttacgtaatggataatgatacaggtagtcatgaatgattgccgctttggcatattcaccatccggtggcaataatgaccagaaaatacgcggaacagtggcaaggtcggtaacgaatcctaccggtacttcaatgacatcatttttatcttcactgagataaaacctgaatggctcataaacacgccatttataatgacctaacatttccataattgctggactggtaaaacaactcataattttaccttataataaatatatattctgcaccttacgctcaaagtacatgtcgtaaactctatttactcattaacagcttcgtgccaaaaaggctacgggataatgatcagaagcgagttgtggattacgtaatgcttcaaccctttgtgaataaggtgctcgatcgacaatgaccccataatctaaaataccaccgccaatttgcgtgggttctgtaggtgcgagtacggctacaactcgttccagatgctcagtcatcaggtcattttcaagtctgtctgggctgcgattaaaatccccggcaagaaaccaggataaatgccgcatctgaggttgtctaaaaaaattaatggtaaccctgacaatagctgcagcatccggacctccactagccagtgcgtgcgctgtcagaaaaacatcattacccagtccgatgccaatgacggggcgagatgcgacagttgtcggacgcaagacataaacattatccgctctttgtctggaaactattgccagattaacacggcgtgctccaacatcaatagccgagtggtagatatatcttatatcctgacggctggtggttccgagattccaggtgtattcatcaatgggaatacccactccaaaaggctgaatatgtcgtccggtaggaaccgctgaggtgggaacagcaccggcctcctgtaccataagaatatccacaccggcagtaccacttaaaagctgtctgacattgacattccatttactttctgtagatgctgaagagccctgaagattccaggtcataactttgtagtcactgatattagcgcaggcaaaagaaatatagctgcagatgatcatggtcagaaggaaaaaaacaggttttttcataatatctactctcccgagcattacttctttatctgaatgatatatgtgttaataacccattgtttcatgacgttgattttattctggcaatgcctgacttgtttctggttctatgtcttgtgtaggtagtaagatacatagtctaacgtcaataaaactaaaatggatgtctattacagaggtaaaatgaagtttattcagtacaatcaattaattattgttaataccaaagagacaactatgaataaacaactaactgaatttaaaactccattcgcttaactcattgtaactgtattgggttgatttatttgcggaaagagagattcgatatcattggtactttataagtaaacataaatttttcattaccaggattattatatccctgtgagggaggtgacatttcatctattctcactcttgtagtgacatagtaaatttggccacctgattaaaggcgatgttctcacctcaacacaaaacaggtaacttagtgaacaagaaaaccaaacaaatcaatggttacatcttgaacggctacaatagcgtcagacctcatcattataacggtgcactgacgccggaagagtctgagaacaggtaccgtttttactgtaaaaccgtgaccaatagcgtcgatgcgcaacaaaacgtataatccgttgatagggcgtacaggtgtggcactgggcaaaacgttcagtgacaatgactggagctggcggcatttggcaaatagcatgttgaccacgctataaacgccaacttccgctacatgttctgagtggtggcgtttgcgttatatcgtcacagacagcgcctcagggcgctgttttcgatcggacatgtcgctttcgcaggaggggacgttattcggcgaccagccacatatcagcctcttcaaacatctcttccagcatacggtgcagccgttctttctcggtttttgtacagtcactgtttaatgcgttcgcctgcattggcttaactttcacttgcgcatcgggaaaaagttgatgtacgcgttttgtgagttcattgaggatgatttcgcgtgcgcttggcaaaccttcaacatttcgcttgtcataaacgagttcgacgaacatcgctatttcctttttactggttggatgaccagtatttaagctgggtatataaccggtgtcaaggtttagccgccgttttgtcatcctaacgttgcggatgtaaagtaaattgatcgcacatggaagtaaaggtcgctaacctgttgtcatgtcaagaggttagcggctctctcttcacagcggtgtcctgctacctgatggtaaattccagggcgcgactaaaatcgcaatcggctaacacaacagggtcgccttttctgacaataatgctatttgtgcccaggcattttcggctctgtttccccttaattttgttatcatcagtgagccagcgctggttatcattacccgtgcatgaataaagaatgattggcgtgccttctttcgtaccctgtcctgcagcatccagacatttctcaccctgcgtgattctgtctcggtgaaatgagaaaagctgagattgcacatgtttacactcccgcagcgtcaaacgattctgttgatctgggcctgtatcaaggcacagaccatcagttgtccgaatttgttccgcgtcatttatgtaataaccaccggaattaatttggttttgtgtaatgaccgggaacgacaaattaatactataaggtgcgggtaagccgttcgtcgtacatccacataaaatagaggagaggcagagaaccagtgtgttttttcctgaaagcaaagtcattcaattattaccctaaaaataaatagcattacaactatattggcaatttatacccactgaatatgacgtagcattgagcggcaataaagataattccgatagaatcacataaatacttcggttaaatgcgcgcagccagccactcctgcgacgatgggtatatagcgttaaatacttttgcaatattacatgctatcacagtgaaaaacggctgtacatttcttcacgttaaacaaagtgagaaggggggttgacacccgatatatgataaaagaggtcacaggagtcattagcaaaataaatcttttagattttcgccactgaaaacattctgcagcctttcaggcaaagcctcatagcagactgcggaggtatacgtactcgctaaatttttctgaaaaaatgccgggtgacgaattatgaaagataaacgttggcggcggtaggtccgcggagtccattaatacgacaaaactcaacgcgtataccggggataagagcttctgtttcgtgttggcgacatgctgaaatgtggacctgaacatctttgcgtccatcggagggggtgatgagacctttaccgctcttacaatcaaaggttttgacaattcctgtcattttacgagacaaacaaattccttaatggggataacgaggcgcactatacacgtcaggaaaaataatgccagctatatttgatggcaatcaagatttccggatggctaaaagtagtcgttcggcaccattgtagataaataacattatgttctggagaaagtattccctttcctggcgtcgttggttggtgcggacatcatgggttttgccgtcgggcaggatggtgaactaatctgcctggcttgctttttatcggtatttgtaggtggttgcggggttttactaccaaaatcgtagataaaaatttcccatgatgcctgttgtaaaccagaacaatggtctgaactggccaaaacatggaatgaaaaaataagtaatgaccaaagcataaaagcatgatgtttcatagcacctcctgttatatgtaatgacttgcgaagttcatctaattaattatgggacgtcattggcattttttattcaacgaagagttaaccactcttaataataatgggttttatagcaaaatagacttttttatcgagtgttcaatatttgcgtccgttattatttttctggaatgtaaattctctctcaacacaggtgaaatttatgtttgaattgtggtgttgattctattcttataacaagaaatgttgtaactgatagacatattaaaagattgaatcggagcgggaataaagcatgctgaacatcatggtgaataggattacggtgccagcgatggcatgtaacggcatttcgtctggagcgtcacgtgaggactgtgaagcacaatgcgatatgttctggttatatggcgagtttgcttaatgacatttttttagccgatcagcgtcaggcttcttaatgtggttgtgatatttttctttaaatatcaaaagtttgtatgacgtgtttgttgttttatagtggctaaacactttatggtttctgttaaatatatatgcgtgagaaaaattagcattcaaatctataaaagtgagatgacattgtagaaccggttaccttaatgagcgatagagcgcttcggtagtaaaaatatctttcaggaagtaaacgcatcaggagcgatagcggtgaattattcgtggtttgtcgattcggcatagtggcgataactgaatgccggatcggtactgcaggtgtttaaacacaccgtaaataataagtagtattaaggagttgttatgaaaaatattattttatccactttagttattactacaagcgttttggttgtaaatgttgcacaggccgatactaacgccttttccgtggggtatgcacaaagtaaagttcaggatttcaaaaatatccgaggggtaaatgtgaaataccgttatgaggatgactctccggtaagttttatttcctcgctaagttacttatatggagacagccaggattccgggtctattgagtctgaaggtatccattaccatgacaagtttgaggtgaaatatggttctttaatggttgggccagcctatcgattgtctgacaatttttcgttatacgcgctggcaggtgtcggcacggtaaaggcgacatttaaagaacatgccactcaggatggcgattctttttctaacaaaatttcctcaaggaaaacgggatttgcctggggcgcgggtgtacagatgaatccgctggagaatatcgtcgtcgatgttgggtatgaaggaagcaacatctcctctacaaaaataaacggcttcaacgtcggaattggataccgtttctgaaaagcataagctatgcggaaggttcgccttccgcaccgccagttacaaaacagggcttctttaccagtaacacgtacctgcctgtcttttctctcttcgtcatactctcttcgtcatagtgacgctgtacataatatctcaccagcataagcacagataaaggattgtggtaagcaatcaaggttgctcaggtaggtgataagcaggaaggaaaatctggtgtaaataacgctagatctcacaggattcactctgaaaaattttcctggaattaatcacaatgtcatcaagattttgtgatcgccttcgcatattgtacctgccgttgaacgactactaaaaagtagcaaggtatgtattttatctaggagagcaccttttttgcgcctggcagaagtccccagccgccactagctcagctggatagagcatcaacctcctaagttgatggtgcgaggttcgaggcctcggtggcggtccaatgtggttatcgtataatgttattacctcagtgtcaggctgatgatgtgggttcgactcccactgaccacttcagttttgaataagtattgtcttgcaatcctgttacagaataatttcatttattacgtgacaagatagtcatttataaaaaatgcacaaaaatgttattgtcttttattacttgtgagttgtagatttttcttatgcggtgaatccccctttgcggcggggcgtccagtcaaatagttaatgttcctcgcgaaccatattgactgtggtatggtccaccgggaggcacccggcaccgcaattttttataaaatgaaattcacaccctatggttcagagctgtgtttttacatcaggtgggcaagcataatgcaggttaacttgaaagatacgagcaataacagaaaccagtgatttcgtttatggcctggggatttaaccgcgccagagcgtatgcaagaccctggcgcggttggccggtgatcgttcaataatgcgaatatgaatggttaccagccgctgcgaattctacctgggtcacttaataaagcaaaacatttaaacactcaacaacgacaattcagacagttcgaacttttctttaaaaataggattaaccatgtttaaaagtggttactaattagccattatcctacggtagtgattcacatattctttaacgttacgttacaggaaggttgaagtggaaatgcctgatgagccttcaggcatttctgaaggttagttagctaaggaacagttactgagaacaggtttatcatcaccttccaccagtttagccgttttgcctttggtataaagtttgtaagtataatttttgtctatggcttcgtaatttgctccggaggccattttcattaaccgcatcgggatcatctcgtttacctgactgataatcgcataggcgtttccagcctcggtgttgacgtaaatcacctccataacctggttatcattacaggtgtatatagatttagaaatctcctgcgaagctgctatagaggtggtactggcgctaagcgcagcgagaaagagggtaaatgggatcaatttacgtttcatcattagtatcctttgtgtataaaattgtcgttaattccctgaagagcgggagataaagcggcatcaatacgatgaatgctgtagtattcctgtttactgacgaaaagtgcgccagaaaagcgtattataatttatccatcactgacatatgtgatgagtagacaaatcttaaaatcataaactatagactgcaaatcattatggcgcgatggaaaatgattgtcaccactgctcaatactatggcataaaaaccgaagaaaacggtactgttcactgtctcgtttcatacggtatctgtcagtgaaactatttcttcaaatgatggtctttttattatcgatcagataatggcatcaacaggggttatttaggagtatatgtgaaaaagtggcttataggagggatattgatcgcaagttttctgaccggttgtctgatgtggcacaacattgataaatggtttaataaagatatcgaagttttctacgccggagacgataactaaaactcctgtcagttggcaacgggtgtcatatcttcaggtatggcgcccggagcagccgggcgcaaattgtaggtgtataaaagtcatttcattaaaattttagcgacaacatggacagtcactaccgcgtgctaacggccctctgaagtcacaagatgaataagccagttttttgtttcagcggtgactgaaacatattttgctcctggtgggcttaccgccagttgctgaaaaagacaacgatgatgtaactgttgcagagactgacgaatacgacgaccgtgagttttatttttggcgaccatatttcctcccaaaaggccgcccgaaggcggcgctgggtttgataatggagaagggcgttggtcactgccataaccaacctgtatacactaatgtaattgataatcattatcaattgtggtgatgaagaaaaattgtaaagatgaagggacagcggaaatggcaatgaacgggatgagatttttcgttaaccacttaaattcgtgactaaaaaaagtcttttataggcttgaaaatgttttttccgtccctatgtagtcagtggacaagcaatgcttgccttgatgttgaacttttgaatagtgattcaggaggttaatgatggcactcagaaccttgtcagcacttcccgtgtttgctgattctcttttctctgaccgtttcaaccgtattgatagacttttcagtcaattaacaggagatacgccagtcgctgcgacgccagcttacgatctgcaaaagcgcgatgcgaataactatctgcttaccgtgagcgttcctggctggaaagaggaagagcttgaaattgaaacggttggcggcaacctgaatattacgggtaaacacactgaagagacggtagaggatcagacgcactggatttatcgtggtattcgtaaggcagatttccagttgagtttttctttgcctgaacatgctaaggtgaataatgcaaaactggaacagggcctcttgttggtagagatttaccaggaaatccctgaaagcgagaaaccgaaaaaaattgccatagaaagcaaaccaaaggcgattgaacataaatcataaaagcattaatggaggcccgtttagacgggccttcattgtctgtagcgaaaagtatcccgtcatgcttgtaggcacagatcgctaaatattatagccctgacctctatattatcccgtgccactgacctcgtcgccattggacggcggtaagttggaattatccgcgaggtcagtccaatttttgtccactctcgacattctgcctgttatgggcgcgatacctgaacataaattcgtatagcggttgatcgttttcaccgcgttgatgctatttctgctaacactactttcatacgtaaaaaagctgatgctttttaccttatttaatagaggcaggtatgaaattagcgctcgtcaatcgacaggtcattttaccggaaagcggaaccgagtccttccagtgccatgcctctacgcttgttcgcctaccgtgcggtacgctcgtggccgcatggttcgcggggttgtgcgaaggaagcgaagatacagccatctggctatctcgctatgaacataatatctggacaacaccgcagcgagtggcggcacgcgagggggaagcgcactggaatccggtgttattttacccgtcggataaattgtggttattttataaagtaggcagcggcgtacacgtgtggaaaacctggtttatcacctccagcgatcgaggatttacctggagtacgccagctccgttggttaacgatgatattttgccgcgcggtcccgtaaaaaataaactcctgctggcatcaaatggcgcctggattgcgccagggtcgattgaaagtcctgaacggtggagggcatttgtggatcgatcctctgacgaaggaaaacactggaatatctcttttgttccgctggagcctgataacgctatttccgggacaaacgtagcgttgtgggatggtgtaaaaaaggggatgttgtgggaatgttgtctggaaaacctcctgcgctgggatggcgttattcagcctacgctgtgggagtcttctccggggcatatccatatgttgttacgaagcacacgcggggcaatttttcgcagtgattcaatcgactatggcgctacctggtctgttgcccgcgcgacatttttaccgaataataatagtggtatcgatctggttagtatgcaggacggtacgctgattcttgcgttaaatccggtcaacggcaactggggaaagcgctatccgctttcactgattgcttcccaggataatggcgaatcatggctaccgctactggacctggaaagtgaccacggtgagtattcttatcccgctattattagcaagggcggcgtcgtacatatcacctacacgtggaaccggaaaaatatcgtatattgtcgattacaaacggtataaggcgctatcagtcgaaaccgatagcgctggaataataatgccttgcccggcgtgctctctcacgtcgggatggccgaaatagtcatgatttaccgggtaacatccttgaaaatgtatcgtctttttgtatgtaatggtgaaacaacgccgctgctgcatgcatggcaatcaggaaatagccgatattggccagcatttcatgaatacgctttatatccgattttagggtgctatctggcgtcaaaaataccggtacagtaaaaccaaaaaagctccagcttttcccgcctgatgccatcatcgcgacgcccagcagcggtaaggcgagaaaagtgagataaagcgcgatatgcattaatttagcggctacgtgctgccagtgaggagggggaggcgtaatgaccggatccgggtatttgtgtttaagatataaccgtaaaaacatcagcgcccagaccagaacgcccatgtcatagtgcatgtctttcataaataggtaaacgctggagccttttggcgcccacccccgtaactcaatagccgcatatgctatgcctgtcaggagcagtgttaaccagtgaagcgttatttgcagtcttgagaaatgtgccattattattatcctttattaacaactgcttgtagggtatgcgtaaaatcttaacagaaccttaaagcgggggctgagtcgcaaggaacagacagagatagcggcacgtaaaatgggataaaaagccggcggcatcgccggcttactgttgttattgtcctcttacgacaacacaggttttaccataaaacggatatgagcctgtagtttcataatcaacactcgacactaaagaaatatcgcccgcttttttcgctgaatcaatagatgcgtcgccggtatttacaatacccaataccgtttgcgcacacgctttaccggttttggttgccgggagactcgtggcagtaattggccctttaacatccgtatataagccaatccctgtcggtgatggtcctgtagcacaccccgttaaaagagaaccaataaagataattgaaaaaatgtgttttttatttgtcatgggattagtccattataaattaatagaaaacttaccgtccgaaaatgtccggacagtcatttaaaaagtggtgtatattaaatatgcgatattactctttgcaccctcctgttgatgtcgtacctgatggacaaatatccgttgaagccggatatattccccatgccgtgtttttataacttgcgcatcctgtcagcaatgagaacagtacggctaaaaaaatcatcacgagccctggcggcgttaacatttttcggttggactccatagcatgtcatttcatcgggttgccatatgactggcgttctgctggtaagtttcattaacgcctggttcgtttaatattggtttaggtttaaagccaggaagcgctaattacgataccttcttacgtttcagtactgactaataacgttgagaaaatgaacagcgtcggatgggaagacgtaatacagaatagaaaggaaataagagaataagatggcgttaattaacccggtattcctggcgtcatttcccttgcgttttatccccgtcaaaagtggcctttagcccacgttggcgctcccgacgttgacaaccagtgagtgtccatagtgtgcgtatgatgtttttaaaagatcgtcatactttctgttctgcatcaattttttcattacaaatgctcgccataatgccgtcctcaggaggtctcccgacgtttatgctgcgccgggagaaacaaaaacaacgcataatctgggacaaattgatgattaaaggcaaactggcgctcgtgacgtgcgcgctgactctggtattcacttcgtcgcttttcgccgcgtcggacacggcagatggtcgtaccctgaagctggccattggccctgagccaacggaaggctttgatcccatgctgggctggagccacggcagctacttattgcttcatgcgccgttgcttaagcaaaacgccgatatgagttggggtgatttactgacggaaaaagtggataccagccccgacggtaaaatctggacgctaaccttaaagcccgggctgaaattctccgatggctcgccattaactgccgaagatgtcgtttttacatacaataaagcggcgaagagcggcggtaaaattgacatgggcaattttagccatgcgcgagcgctggatgcgcgccgaattgagatgacgctgagccatccgcagagcacctttgtgaatgtactcgggtcgttagggattgttccggccagccgttatgatgaaaaaacgttcgcccgcgaaccgataggcgccggtccataccgactggtcagctttcagccgggtcagcaactgatcgttgaagctaatccctggtatgcgggtaaaaagaatgactttaaccggctggtttttgtctttctggatgaagataatgcttatgccgccgcgcgcagcggacagttgggactggtgcgcattgccccttctatggcggtgaccccgcagcaggataatcttaaactctgggtacgcgatagcgttgaaaaccggggcattgtcttcccgatggtgcctgccggtaaaaaggatgctaacggttatcctgtcggcaacgatgtgaccgctgatgtcgctatcagacgcgcaattaactatgccattaatcgtaagcaactggcggaacaggtgatggaaggccatgcgatacccgcctatagcgcggtgcagggattaccgtggcaaaatccttcagtggtattcagcgatggcgatattgcaaaagcgcgcgccatcctggaagaggctggctggaagataaacagtgcgggcgtgcgtgaaaaagcaggtaaagaagcgcgtctgaccttatggtatgccagtggcgacagcacccgacgggatctggccgaggcggtgcgcgccatgttgcagcgtttaggcattgtcgtctcgttgcaatcgggaagctgggaaactgtagagcgccatatgcacgctaaccctacgctgtttggctggggaagtctggacccgatggaactcttccatcactacagtgggaaagccgctggtgtggaatattataacccgggctattacagcaaccctgcggtagaagcacatctgaagcaggctatagatgcgcctgactggcaaaaggcgatccctttctggcagcaggttgagtgggatgggaagcagggcgcgggcgtccagggcgatgcggcatgggcatggctgcttaatattcagcatacttatctggccaacccctgtattgatctgggaaaaggctcgccagaaatccacggtagctggtcggtgttaaacaatcttgatgactggacctggacctgtcggtgatgaaattgttcttcagtcattttttgcggctgattattctgttggtgctggtggctgccggcaccttcattttgcttagcttttcgcccgttgatcctatccgtgcttatattggcaacgatctgctccatgttccgccagaacaatatgcgcggattgcggcgcgctgggggcttgaccagccgctgtgggagcgtttcggtcactggttttggcgtctgctccagggcgacatggggtattccatgctgttcaacatgcctgtcgccagcgtgatccgggaacgttttgcgacgtcattcgcgctgctggcaggcgcctggctattgtctggtgtgctgggcgtaacattgggttttctggccggacgttttctccaccgttggccggataagatgatttgccgtatcagctacttattgtcatcgttgcccactttctggatagcaatgctgttgctggcgctgtttgccgtccgctggccggtattacctgtttgttgcgcctgggaccccggaaataatgcaggaacagctcttttatcggaacgtttacgccatcttgtgttgccggtatgtgcgttaagtctgttgggcatggggcaaattgcgctgcatacgcgagaaaaaatagccagcgtaatgaagagcgaatttattcgttttgcgcgcgctcagggggataaaggatggtcgctgttacgtcaccaggtgttacgtcatgcgattaccccagcgctctgcttacagtttgcttctctgggtgaactgatggggggagcgttactggcagaaaaagtctttgcgtatccggggctgggacaggccactatcgatgccggcctgcgtggcgatgtcccgctactcatggggatcgttttattctgtacgctattagtgtttgccggaaatacgatttcagcctggcttgtggtggtgcttaatcgatcgctggagcgtcccgatgctctataatcctgccccgacgttgtttcgtctgctcctctccgttacctgtctgctgtttattgccggatacggttatgccacgttgagccagccgccagaggttaatctgcttgcccggcatctgtcgcctgatatccagcactggtttggcaccgataatctggggcgcgatgtatggcttcgttgctttcagggggccttcaccagtttacaaattggcgttggcgccgcgctgtgcagcggcgttatcgcgttagtgatggcggcagtggcgcgcattcatccccggctggacctcctggtgcggctgataaccgatgctatgctcgccatgccgcatttacttttgctgatccttatctgttttacgctcggcggcggtaaaagcggcgtcattgcggccgtggcgttaacgcactggccccgtctggcgctgattctgcgcgccgacgcggagcgggtagcgcagagtgactacctgacattgacctatcgtctggggcatggacacctttattgctggcgatatcactattttccggcgctattgccgcaatggttgacgggaacgttattgatgtttcctcatgcggtattgcacagcgcggcgttaagttttctggggtttgggctggcgccgcatgagccttcgctggggctgttgctggcggatgcgttacggtttattagccatggaaactggtggctggtgctatttcccggcctaatgttattcacgctggtgatgctcttcgatcagtttgcgcgcgccattcagcggctgtggctaaggagtgacgtatgctgagtttacaacgggttacgctggaaagcgcgcgttatcgctggtatggcgcgagacgctggtcgccgttattacagaatgtctcttttgatatcgcgcccggcgaaatggtggcattggttggcggcagcggggagggaaaaagtctgctgctgcaatgcctgctcgatctgctgccggaaaacttacgttttcggggtgagattacgcttgatggcaaccggctggacagacataccatcaggcagcttaggggcaatacgtttagctacgtgccgcagggggtacaggcgcttaatcctatgctgaatatcagaaaacatttgaacagagcatgtcatctgaccggacgcgcctgggatgagacgcagatggtacagttattacagcaaagcgatcttgcaccgacagtcctggaacgctttccccgccagctctccggtgggatggctaaacgaattctggcgtgccacgcctcgctcagccaggcacgttatatcctcgcggatgagatcaccgcctggcttgatacggcactggcaaaccagttgcttgagcacttgcgaggtctctgcgagcggggatgcggcgtgctgtgggtgactcatgacctgctgctggcggcgcggtatgccgatcgcattgtggcgctgcatcagggttatatcacggacaatattcgctgtgaacgattacagccggaagagatgagtgagccgttaaaacggcaatggcaggcattgcctgaactaaacccgttatttatgccgaccggagagggaatagaatgctgagctgccgcgacctcgttattcgtcagggcgggaaagtcttatggcagaacctgacgtttacgatttctgccggtgaacgggtaggaattcatgcgccaagcggaacggggaaaacaacgttggggcgcgtcctggccggatggcaaaagccgacgacgggcgacgttctgctggacggcagcccgttacccctgcatcagtattgcccggtacagctggtcccccagcatcctgaactgacgtttaatccctggcgaagcgccggagacgctgtgcgtgatgcctggcagcctgacccggaaacgttgagacgtttgtatgtgcagcccgagtggctgacgcgtcggccaatgcagctctcaggcggggagttggcgcgtattgcgatactacgcgcgcttgacccgcgagcgcgttttctgattgccgacgaaatgacggcgcaactcgatccgtctattcaaaaagcgatatgggtatacgtgcttgaggtgtgccgcagccgttcattagggatgttggtgattaatcatcagtctgcgctacttgatcaagtctgtacccgccatttacaggtggaatagccgcaagtcgtttctccgcattgtcgtgtcgccgttaacgcaccgggagcccatgggttcccggtattgtcggcagagattttactgcatgacgcgtttatctgcgttttttgcatcagcggtattactgtagtccctggtctcttcaacctgtacaggggctctgacgaccagacttggcagcgccagttcgatatcattctcaatgagtttttcaataatacggatatttatctcttgctgaatatccatgtatttattgtaatccgcggtattgacgatatgtaccacctcataggtcagccgatcctgaccaaaggccagtagatgggcgcggtcgaattgtgtttcgccgacatcggtaataatctttttcaccatatcgccgatgaggcgtaacttttccggcggtgtcgcagtggcaacgccaaaagtaaacacgatacgacgcgtttgcatccgcttatagttgtgtatggtttgctgcaacaactgcgcgttcgcacaaacgatctgttcgccgctgaggctacggatgcgagtggttttcaaaccgatatgttcaatcgtaccggctacatcattaaagacgacgaaatcgccgatctcgaagggcttatcgaaaccaatcgacagcgaagcgaagacatcgctcagaacggtttgtaccgccagggcaatagcaataccgcccacgccgaggctggctaccagtgcggtaatatccacgccgacgttcgccaggatggagagcaacatcatagaccagacgagcacgcgcaaaatcataccaagaatgactaacgtcaccgggtttttattggagcctggggcatacagtaaatgacgcatccatgactgtacgccctgatcaagccaaatcgccatttgaatcgcaaccactaaaaaccaggcgtgagagagggtagagaataaccggtcgggcagggcgacaaagcgcaggctaaagagaaatgcggcaaaaaagatgagcatcttactggtctttttcagcatctcgaaaacaataggccgcagccgcccatgagcatcatcctttttatccgggcgttgtagcgctttatagaccacattaagtagccagttgatgagccagtaagtaatgagggtgacgaaaaaaacgaccgccagattgatccagaacgtcgttgacatcagcatcgcaacgatatttagtcgtgctaaatactccattttacctccgatgaaaagcagatgaacattacagtatagacgtcacatcacggaggccgatttccggctttactattgctgttttattcagcacttttgttcaaaaagcatgaaaaagaggggtagccgtttggctatcccggcgtttctgtgcagacttatctactcctcttaataaaataaggagtcatttatgcaacaagaacatcgagagtgtattgagcagtgttatgaatgcgcggcggcgtgtgatatctgcgcctcttcttgtctgcgtgaagataacgtcgaaatgatgaagtattgcatcgagttagatatgcaatgtgcggccatttgtcgcctggcggcgcaatttatggcattggaaagcgagtactcacaaaaattatgccgcctgtgcgcggatatctgcaaagcctgcgccgaagagtgtgcaaggcacgatcacgaccattgccagaattgcgcgcgggcatgcagccaatgcgcagacgcctgccttaaaatggccgcgtaatttttcttccgccattagctcaaccggatagagcatagagcttctacctctaaggttcggggttcaattcctcgatggcggaccagttgatatcaaaaaaggccacctgcgcggtggccgctgagtttctgttgaaataaatgcaatgttataatataacaatcatctttctaagaaagatgagggtaacgttttggtgattcatttaaaaaaactgacaatgcttctgggaatgctgttggtcaatagtcctgccttcgcgcatggtcatcatgctcatggcgcgccgatgacggaggttgagcaaaaagcggcagcgggtgtgtttgatgacgctaatgtacgcgatcgcgcgctcaccgactgggatggtatgtggcaatccgtctatccttatctggtcagcggcgagctggaccctgtcttcagacaaaaggcgaagaaagacccggagaaaacgtttgaggatattaaagcgtattatcgcaaaggatacgcgacgaatgttgagactatcggtattgaaaatggcgttatagaattccatcgcgacaataacgttgcatcctgtaaatacaattatgccggctataaaattctgacttacgcatcgggtaaaaaaggggtgcgctacctgttcgaatgtaaagatgcgaatagcaaagcgcctaaatatgttcagtttagcgatcatatcattgccccgcgcaaatcggcgcacttccatatctttatgggaaatacctcgcaacaggcattgttgcaagagatggaaaactggcctacctattatctttatcagttaaaggcgaatgaggtcgttgacgaaatgctacatcattaagtctgattgcaatgttaaaagctcgctatgaatagcgagctttttttctgccgttatgccatatttctggcaatcaatataaaaaatacctgcgcccccggagcaacgatgacgctgtccataccgccctcgattcaatgccaaacggaagcggcgtgtcgcctgattactcgtgtcacaggcgatacgttgcgtgctattcatttatatggttccgctgtcgcgggcgatctgaagccaaacagcgacattgatctgctggtgacaatatgccagccgctgacggagacccaacgcgcaacgctgatgcaggaattgctggcgctttcatcgccgccgggggcgtcagcagaaaaacgcgctctggaggtcactgtcgtgctttattcgcagctggttccctggtgttttccaccttcccgggaaatgcaatttggcgagtggctaagagaggacatttatcaggggatttatgaaccagcgcagcaggactgggacatggtgttactgataacccaaattctggaaaccagtataccgctaaagggagaacgcgcggaacggctgttcacgccagcccctgcggcgcagttgctgaaggccttgcgttatcccctcgacctttggcaatccacggcagatgtgcagggagatgagtatcatatcgttttaaccctggcgcgtatctggtacaccctttctaccgggagatttacctctaaggatgcggcggctgactggctgttacctcagttgccagaagagtatgctgctacgttgcgtgcggcgcagcgtgaatatttaggtctggagcaacaggactggcatattttgctgcctgcggtcgtacgctttgtggattttgcgaaagcgtacatccccacgcagttcacataagatgccccaggacgtctgtcaggttgcgcaaacggcgttcctcaactactacttaataggttctcatcgctgaagtaagcagatgatcttatgcgggccatcgaatggatattcccacatggctctcgttttgttgaggtggatatgactggttccgcatcatctgttttaaagacagatacaagactattgagcgaaaacctgtttcttaattatggtctggagtccttatttaaggacgtcgcaataatagctggcaacgtaaattatattgtttttgatatcgacgattactacaccgtacagcagtatattacttccacatttaaaacggtactcattgggattgttacccataatgaatataactttattgatgaacatcatgctatatatcgaataaaggtcgatgcctctattgctgagtggcgcgaattactgattttggccgctgctggtcaattttttcccagatcagagaaagtcagattaacggcgaatgaaagaaatgttttggcgatgcttgttaaaggaatggatatccgacaaataagctgtgagctgaatgtacatttaaaaactatttactcagtacgctaccatgtcctgactaaattaggttgtagaacagttctggattatcaaatactgtccgtctctaaagcctttacgcactggcttacaataaataatgtcgataatgtaattttccgtgtaaatagcaaggtcattgcttaataatgatttgcttctgatggcgtttaggttcactatgctttcttacatcatcatgaggccagacaggcatggctacttttagtattagcgcaatggcggcgcagtgtggtgtcacaacagcaaatatcaggtcctgggaacgctatggcctgcttcaacctaccaaagatgaagctggcaatcgtttttattgcatagaagatgctatcagaatacagcatattatcgacgcgttaagcaaaggcttctcattaaaagagattaaacctgccctctatggtgaagaaacgcattgccgctcgggatggttattctaccaggaagagattttagcgcagtgtagaaaattcgaacccgccaaattgcgaaaattactctggcgttatggtcgggaaattccgccgtgtatcgtaattgagtcaatactgcgtcctttatggctgtggttgtccgcaggcgatgatgatgcacgccgatttgaaaaggcattactggatactgcgattattgaatacgccacgttccagctaagtagcgtacgaaaggcgccagcaggcacaatgcttattgctgcgttttcgctgaacgaccccattgagctatggctggaaacgattaaatattgtagtgaaggtatgcgagttgaagtcatcccctggcaggcgccgatgcccgatcttttatcaacgtctttcgagcatattgttttgtggcatgatgagacattaactcccgcccaggaaaatcttattcaggctttaaaagaatcgggtaaatttagtcttcatgtgaaaaatggctcaggcttaacattactgccagccgtataccggcagcatgagatgcccgaaagcatgcagcatgttgcaccgcaaatccatgcaaacggctacgaaaaatcaggcaccgcacgttgaggcatctgcattattaacgaacaggggaggagtaaccccctcccttgtttatacccttcatacttcaagttgcttatgtgttggctacggattactcggcccatccataggcctcgccctgacgggccgtcgcaagcgacgttcaaatctgctcccggcagatttgtcgctcaccccagtcacatagttatctatgctcctggggactcactcccttgccgccttttagcaacacgaattattttgggtatatattagatgtcgtcaggtgtctgaaaaaaaacggcttctaaggcattgcggtaaatatcaagctgcactacgtctttttctgtttccagtttttcaataagtttggcgatgatatccttatttgagacatgctgctgcgattgcaatagttcgtaagtaatttcctgaatagctcgctgttcacataacatatgtgcagaaaaaggattgccagtactattttgttcgttgactagtgtaatggtagtcatatttcaccatattcgatgtaaattgaagccgatctccctgagcgggggagagaaattagtgacctattaaagttagacctatatcataaaactgtaataaaaaatcataaaaacgtgatgtgcatcacatttgtgtgatttgttgtatattttatacactttaaatgaaggtgaagattccgcagaatcaacggcctgttcttttttctcactccagtttaaacgaataagcattaatacccatctgtaataattacttaatgttatcttaataaaggtaaattactgtcagacctccgtaaaaggaggttgattaatgattcgtcatatcgccatttttctttgttctttattgatgtgcagcaccacttttgccgattcggtaacgtcggtatcgcttggcgcgctcttaaccgcgctcaatgaacgcatgttattaatgaaagatgtggctgcttataaaatgaagcaccatctgccgatagaggatttcacacgtgaacaaaatgtttttgccgaggctgaagaagaagcgaaaaataacggtctggacccgcattcgataaccccttttattcgttcgctaatggatgccagtaaagcgatacagtaccgctatttagcgcagtggcgaaccggctcagaaccctcctttccgatacaaaccttgtcggtcacccggcaacgtattcgacaacttgataatcaaatgttgatcattatcagccagcgcctgatggtcggcgctttcagccatgaggatatggtgtggctgagaacgcactttaatgcgccgaatctgaatgagagcgatatcagtgatgtgttggcagccctatctttggtgcgacacgcgcgttaatcccccatgaggaaacgtgggccaatacctggtgattgcctgcgggggcgcgataaaagaacgtttttgggtgatggggatataagcgtggcggaatagcggctggagagacgtggtttcgcttcccatcttccgatgcattcgttagcatactgtttcgcagctaagcgtaaatgttttcaggaagaggttaatgtgttcgcggagtatggtgttctgaattattggacgtacctggtcggggcgatttttatcgttctggtaccagggccgaatacgctttttgtgcttaaaaatagcgtgggacgcggggttaaaggaggatatcttgccgcatgtggcgtgtttatcggtgatgcgatattaatgtttctggcgtatgcgggcgtggcgacgctgatcaaaacaacgccggttctgtttaacattgttcgctatctcggcgcgttttatctgctctaccttggcgcaaaaatcctttacgccactctgacctcaaaagggcgtgcggcgacggaaacggtagttccttttggcgctatttttaagcgtgctttaattcttagcctgacgaatcctaaagccatacttttttatgtttccttttttgtgcaatttattgatgttactgcgccgcatactggggtgtcattttttattttggccaccacccttgaaatcgtcagtttttgctatctgagctttttaattctttctggcgcttttgtaacccactatattggtaccaaaaagaaactggcaaaagtgggcaattcgttgattggccttcttttcgtcggatttgccgcccggctggcaacgctccagtcttaaccccctggacccgtcgtgaacggcgggtcattgctctcctttcggttttattgcgtggaaaacagcaaaatagtaaccaataaatggtatttaaaatgctgtttttggagcgtaacctttttacgacagcgatgagattatcgctgagtaacctgcgggaagagggaagcaaatgcggcaaattccacaaaatcatatccatacacgttccacgcccttctggaacaaagagacggcgcctgccggaattttcgaacgccaccttgataagggaacgcgacccggcgtttatcctcgcctctcggtgatgcagggggcggtcaaatatctcggatacgctgatgaacattgctctgagccggaagagatcatggtgatcaatgccggcgagtttggcgtgtttcctccggaaaagtggcacaatattgaggtcatgacggatgatacctattttaacatcgacttttttgtcgcgccggaagtactgatggaaggggcgacctcacgaaaagtcattcatgccgggagagaataataatgggaaaagctacttataccgtcacggtcacgaataatagcaacggcgtctctgtggactatgaaacggaagcaccgatgacgttgctggtacctgaagttacagcagaagttgtgaaggatttggtcaataccgtgcgttcctacgataccgaaaacgaacacgacgtttgcggttggtaaagatgctgtagtatctatttgatataaaatgattctttaaatgagaagccgcatcgcgcgtcgccagcgtgatgcggtttttgcgtattgaaaagcgctgtttatttacatcagacatgggttgaaaagaaacattaagaaaacattaagaatatcgcattgtttgctaatgagagcgtattcataaaacttatgattgggtattaaaaaccagaagagtcttatgatcatgaaactcgatacccgattaacttcgtcagcacttactcttgcgcttgccgctgtggtcatcccgtttacggcggactggcaattgcctttgcttaacggcgtggtggtccgatggattgaaaacggacaagcgttatggttactgtttggggcgctatttaccgcctggtatatacggccactttcccgtcccgaaggggcaaagcagttttggctatgggctgttgtctggtgggtggtgctgttgggtagaagcaccagttgggggcgtgactatttccctgacgagccgcgtatgctgttcagaacgatttcagtgctattaattgctgcgttggtattgccagtcctgttttttgccgggctacgtaaggagattgttcgtcgtctgcgggacgttcctctgccattgtggctgtttaccgtgacggcatgttcatatctgatttccgacactgtcgagcatcatcggtggttgtcgccgatattcctgcataacgctcgttacacagatttgattgaagagctttatgaagtgccatttatgatcggtttgtttatggtgaccgtggggtttatgcagcaggacaagcaggatgaatgtactgcgctggagctgaccccgtatcacgcaaaatagcgcggctgaaaaagaccatgaattcgatatgggatagatagcagttagcaaaaaaagcccgcactcggtgaggcgggcaaataatactggaagcaatgtgagcaatgtcgtaccgaacaggtgggttataaactcaaccactcggtattgataaagataatcgttatcattaatgattgcaaccctgatatttatgcgcttttatccacgacgctaaaaggtgatggatatcacaaacttcactttcctgacgatgtgctattctttttaacggcaaataaaccgctaacgttaagacataagtgaggaaaaaatgggtattctttcatggattatttttggacttattgcgggtattttggctaagtggatcatgccaggtaaagatggcggcggattctttatgacgatcattctggggatcgtcggtgcggtagtcggaggatggatcagtacgttctttggctttggcaaagtggatggtttcaacttcggcagctttgcagtcgcggtgatcggcgcgattgttgtgctgttaatctacagaaaaatcaaaagctaaacgcagaactttcagagataataaaggctacgacaggtagcctttattattgtctatggaaaacccccagctaggctgggggttccggaaagctttcagctttaagccagttattaaaaccccttttgatttgttaaaacatcttgcggtctggcaactgcaaaagttcaacaagaaatcaaaagggggtcccaatgggggacgaaaagagcttagcgcacacccgatggaactgtaaatatcacatagttttcgcgcccaaataccgaagacaagcgttctatggagagaagcgtagggcagtaggcagcatattaagaaaattgtgtgaatggaaaaacgtacgaattctggaagcagaatgttgtgcagatcatattcacatgcttctggagatcccgccgaagatgagtgtgtcgagtttcatgggatatctgaagggtaaaagtagtctgatgctttacgagcagtttggggatctaaaattcaaatacaggaacagggagttctggtgcagagggtactatgtcgatacggtgggtaagaatacggcgaagatacaggactacataaagcaccagcttgaagaggataaaatgggtgagcaattatcgatcccgtatccgggcagcccgtttacgggccgtaagtaacgaagtttgatgcaaatgtcagatcgtatgcgcctgttagggcgcggctggtaagagagccttacaggcgcatcagaaaaacctccggctatgccggaggatatttattcaaaatgaatttaccaccagcccagttcggtacccgccaccgcaattagcgcgatgcccatcaacaccatcgttgttttcctcatggttatgctcccggtgcggcgtaaccgccaataaaaaaccatgccaaaaataatattgccgtaatgaaaatgacgacagggaagaggacacccactctcatgctattaccttcactgttcagggggcgccagaatagcagggttttctcagcgacaaaaggttggttgctttgtgacagggcgtggctattgctgacttaacccgggataaacacccactaaagcgctgacagaaagtatggaaatagcgtacccgccaggttatcctggacaaaatatcgctttaaggagtcgttatgaaatttacgtggattgcgttgccaggcgtattgctgctgagcgcttgttcatcgtcgcaacccaacgcccccaggccgccgcgtattgggatgcctaatccggcagccgtctactgtgagcaacagggcggtacgctgatgccggtgcagaccccacaaggcgtgcgttccgattgcaaattgcccaatggcgaaatcattgatgagtgggcattatggcgcagagagcaccctgatacgaaaaagtgacaacctgcggtccgacgggatatgattaagaacaatctgataatgagtttcatgcggcgcaagaaaatatgtttcagttaaagccgggcgcgttggcaatagttattggcgctaagacacccgccggacggcggaatattggtaaatcggttgagctattttgcctgtgccaacccggagatgaattcattaatccggtaaatggacacgtcaccttactgccgaaagaagcgcctcgggcgctgtggctggttacgggcgacgtagcctccgccgatggtcagcacggttttgcctgggtgcgagcagaacatttgatgccgttgtccccggacagacaaccaggccaggcggcggcacgacaatcacagctctcgtagccactctgccagcacaatggcatggttctggcgagtatctttagcggcgtatagcaacgttagcggttggtgtcgggcaatatccgccagacgtttgccttcttgatgctgttgcgcaagttctgcccggtattgctgcgcgaagtggttaaaatcaatcagttcgctatgaaaggctttgcgcaattcggtggagggcgtaatggccttattccattcatcatagaccagcgctgcttttttaatgcctcgcggccatagcctgtcaaccaatacccgataaccatcgtctttttccgccgggaaatagacgcgcttacactggattcgcatttttccctcctgtgatggtgtcgcttacggtacttttgtcggatagcagtaatgattttaatggatcaggcctgataaacgaagcgtcatcaggcattcaagtgggtatcaggtttatttatgacgctatctctcgatcgcgtccggcgtagaggccgaaaatcgccatgatgatagccagaaccgttacgcccgatagcggcagataccagctaccgctggcatcatgaagttttcccatgacgggcggcccacatgccgccagtaaatacccgaccgactgcgccatgccggaaagcgccgccgcctgatgcgccgaactggcgcgcaggccgataaacgtcaggccgaggatcatcgtcgcgcctgaaccgaagccgaacagtagcgtccagatgatcgcctggcccagcacaaaccaaagccccgccgcgcccagtgcgcacaatagtgagaccagcgcggcaatccagcgttgaacgttaaagcgatgcaaaataagcggaatagctaacccaggcgccgcggtcgccagttgcagcaggccatgtagcgatcctgcctgtgcttcgctgtaaccgtggctgatgagtattgttggtaaccagccgataatcacataataaatcagtgagttaagcccaagaaacagagtaacttgccaggctaaaggcgaacgccagataccgcgttcatgtaatgcccgggagctactcaggttagctgagcgggtagtgcgccactgcggcaaccagataagaaacgccaacagcggaaacagcatcagcattaacagcgcgctgcgccagccaaaaccgtgcaacgccagcggaaccaccagcgcagaccccaacgcggcggcggcgcccatcgtcaatgagtacgcgcccgtcagcctggcgacatgttgtgaaaaatcgcgcttaatcaatcctggtagcagcacattacccagcgctatcccgcacccaataatggcagttccggcaaacaacaatgcagcggagggcagggagcggagagcaatacccgcgcaaatcagcagcattgcggcaaacagactgcgttccatcccaaaccggcgggcaataccggccgccagcggcgaaatcagtgcaaacgccagaagcggcaaggttgttagcaggcccgtctgggcggtggaaagaccgtaatccgtacggattgtctccagcaacggcgcagcgccggtaaatgttacgcgtagcgtagtggctatcatcaaaataccggcaatcagtaaagcgccctgtttgccgcgtggtgaaagggctgtcgtcatcgttttctcatctcgtcaggcgaggcgataccttaacagtttttactgtttggatgaatcaagctaaaatgacaatttatcgctaaaatcggacaatataatgattggcctgagactggacggttacgatcccgaccttcaccacgatgccgctgtggccttttgtattcgcgccagggatgatgaactgtttagccctcgccatcagcatcgcaagggacagttgatcctcgctctgcacggcgcgatcacctgtgaggtggaaaatgcgatgtggatggttccgccccagtatgccgtctggctccccggctcgctgccgcacagtaatcatgtgaccgcaggggcggagctgtgctttttatttattgaacctgcggcggtcgtcatgccggagcgttgctgcacgctgaaaatttcgccgttatgccgggagttgattttgtcgctggcgcgcagaaccgattccgaaagagcgcaaatgccaacgcagcgccttattcaggtgttgtttgatgaactgccgcagcagccgcaggaacaattgcaattaccagtatcggggcatccgaaaattcgccaaatggttgagacaatggcgcaggagcacgcgcgatggaatacgttagggcagtgggccagcgtattcgcgatgagcgagcgtaaccttgcccggctggtcgtcaaagagacgggactcagctttcgtcgctggcgtcatcaattacaattaattctggcgctacaagcgctgatcgcgggacgtaatgtacaacagacggcgcaaatgctgggttatgattctaccacggcattcattacgatgtttaaaaaaggcctggggcagaccccaggccagtatctgacgggcgagttactgctttcccacaattaaagagaccagccccgccgcaatcagtgggccgaccggcacgccgcgaaacagcgcgacgccaagtaccgtaccgaccagcagcccggcgacgagctgcggttggtttcccatcagcgtaatgccgcgaccacccagccaggagacgaaaacgccgacggcaatcgcgaccagcgatttccagttcacaaaagagtggatcaatgtggagggcggtagggttccgctggcgatgggggccatcacgccgatggtcagaatgataatcccgacggtgagcccctgtttttcaatccagggaaaaaaggtattcaacggggttacgcggacaataatcagcaccagaattgagacggcgacagtggtgttgtgactaataaatcccagagctgccagtccgagcaggatcagcagagtgacatcaaacattatggtttccttgccaaaaagtaagcctgactactttacgcccaaacggcaaagcgcacaggcctttttaacgattgatgcggatttcaggcaactgcctgaaagacaatttctacgtgaaaaacggcgttgtcattaaattgacatcaacgccgcgtattgctaaccggtgaaccgtcattgttgtcttcctgaggatacaattatgtacgatccaccgtttcttgaagcgctgatgataacagcgtcgtttttcgccatttttatcattattgttgtgtctgtattgctccttgaaggggactaagccgttggcgatgactgaaagcggcggaagactgccagttctggtcgggcgatgcgcagatagtcctgtgtattcataatgactgatttttccagcagaccggcattaaaggcaatttcatcgaaacgctcaaacaggagcggatcggcgaccagtttcagattggggtgaaaactgaaaggcgggatcgcgccaaaaacgcagccggtcaacatatcgacttccgccgggctggcaagggaagcgcgtaagccgcccagatgtgaagcaagctgagagaggtcggcttgctgatcggccgccagaatagcaagaacgtgctggttgacgccgttgcctttgactttacagaccagcgcttttgcgccctggcccagcgcagtaccgcgtatttcagataccgcttcgcattttcctactgcttcatggctcaccacacgatagcgcgcgttctcctgggttaataaagccactaaacgttggtgtgtagcgacacccttcgcgacttcagccatttcggccatttcttcctcctggtacaatatgaacatttactgcgaagcactatgatgaacgatgttgtttttgttgtttgttcagatagagctgcgcatcggaagcctggtaggcatcattaatcgtatcattgggctgcatattataaatcccggcggaaaaatggactgtcttatccggtgcgataatctgcaggttacgaataatacgctccggcagatggatagccaaatccgccgcgtaatcaacaagaataatacagaattcatcgccgccgaggcgaatggcgtaatcgcttttacgaatcgatgttttaatcgctttcgccaacagggttataattcggtcgccttcctggtgccccagggtatcgttgatcagttttaacctgtcgcaatcaatagcgacaaatgtcaccggcgtcccggtattgaccaggcgttgcagtcgctgttccagcaccggtgttaatattttacggttgtaaagcccggtcatggcatcgctaatattttcgcgtgtgacgttgcgataaagccgaaagtgcatccgtaccatattaagcaggagcgctgttgccagtaagtaaaaggccagcgctttccaggacgagacaaggaaataggttaaatcaagcgacaacgaaacgcgcagtccaccagggatatcatggttataattcacatattgaaacagattatttttgcttttattaataataatttcttttccggaatccagatcctttagtgttacgttaagataacgccaaaccagcggacggtcctgggtataaaaaatattttttaaattatcctggttaacatccaccatcacgatgccttttaacgatcccgacagatagactggcgttaaaaagctcatgacgttttcctgggtaatatcatccatgtagatacttgaaataaccgtacggccggtaaaaagtttatctatatcttttctgttaatacccattgtgcctttttgtaaaaaagtccaacgatgcatggcgaagcgccgtgagttgattaaatcatagaaatagacataatgtttatttaaatcaacgtaataacggaatttaagctccagtgtgcccagcccgtgactgtggtcgtcctgcgctcggttgatgcttaccgcctgatcaaatgcaggcagtaaaagggcgtcatcaagattatcggtacactgtgtagcgacggtttgcagggtgccatgtagcgccggataattatgccgggtcaggttgacgccgtgcgtaccgttaatggcctcaaaggcgtcgcaaaacgcgcggcgtttttctgcggtgacggggtctcccggcgcttcaaaagttcgcatcaaatgtgcggcgatgctttaattctggtacttatcgtacaaaaacgacgaatcggctctctccatgatataacgcatataggcattcattgccctgtcgctggcaataagttcgtaaatcaggaaggacgatgtcaaaacgatgacgcttgccgagataaagtgcctgagcgctttatgatgcaaattcatgatgaactacagccctgaaagtcggatgcgttagtttaccatagcgatgagaattcctctaacagactgtttaaaaataaaacgtgttgatgttatggaataaaaatcattctcgatttaataaattcaataatatatggtgttgatattttcagtcgtgactattgtcgcaaaaagtaaattgttaattaacggcatcgatttaacactaacgaaaataaaatagcctttattattacgtgaaaggagtgtgacgtggtaaggataataatgtacttccgttcggaggtactatgaaacgatttaaagaaatagcagcaattttgctttttgcattgctggccgtggggttcacgtcgtcggctatggcatcgtcgggcagtggtggtggcccgtgggattttgatatctattttcctggtcactactttttttgcaaactacaaccccctgattctctgcaattaccgccacctcctggtgagtattgctggcattaataaatccatactattccagtgataagtcggcgcatgtaaggtaaatccagtcaggagatatacaggtttacggctattgtagtggcaatatgtataatcgccttgttagtgataaatcagcccgtgacgcattacgggctgatttagggttatgcactttgattggcgctctgtttctgaaacaattcgcggaataccggataaatatcctcctgatcgcgaatatgctgcatggcgaagttatcgaacgtcgcctgcagatgttcatactcgcgccataaggtctggtgggcgcggcgggtaatctcgatatagctgtaatagcgcactaccggcagcagctttttcgccagaatctcatgacacagcggtgaatcgtcggcccagttatcaccgtctgacgcttgcgccgcatagatgttccactgactggggtcgtagcgctctttaactacttcgtccatgagtttaagcgcgctggagacaatcgtccccccggtctcttgcgaataaaagaactcatgttcatccacttccttcgcctgggtatggtggcggatataaaccacttctacgttcttatacgttcggctcaaaaacagataaagcagaatgtaaaaacgcttggccatatctttggttgcctggtccatcgaacccgagacgtccatcagacagaacatcaccgcctggctggagggctcaggtcgtttttcataatttttatagcgtaaatcaaaagtgtcgataaacggcactcgctcgattttagcccgtagttcggcaatctcccgacgtaaccgctcctcttcaagcagttgcgctggttcgctgtggctgatggtctccagttccgtttccagcgcgtgcagttcgcggcgttttcctgccgtcattgctgtacggcgcgccagagagttttgtagcgaacgtaccacgctgatattggccggcacgccgtttgaggtgaaaccggcgcggtgagttttatactcgttaagctggcgatgctggttttttttcagattaggcagcgctaaatcttcaaagagcagatccagatactcatcttttgaaatctgaaaaacaaactcatcctggccttcgccgtcctggctggcctgaccttgaccgctgccggaaccgccgccgccaccgctttgcggacgctcaatgcgatcattctggataaagtgatcgttacccggatggacgcgatggcgcagaccgccgcgcccctgatgaaacatcggttcgctaatatcatcggttggaatagagacggactctccgctgtcgacatcggtcactgagcgtttattaatcgcttcggaaatcgactgcttaatttgtgctttataacgacgcaaaaagcgctggcgattcaccgtgcttttatttttgccgttaagacgtcggtctatgaaccaggtcatatgccccccgtactgccaactgagcgcctgttctgttagtgccggatagcgctaacgcttagccagtctacagaacattactttgtaggcccggtaagcgcaagcgccaccgggcattaacatcacgacgatttacgcacgcgcaggtaccactcgcacagcaaacgaacctgcttacgggtataccctttttccatcatccgatcgacaaagtcgtcatgctttttctgctcgtcagtcgacgttttggcgttaaaagaaatgaccggcaacagctcttcagtattagagaacatttttttctcaatcaccgtgcgcagcttctcgtaactggtccagtttggattacggccgctattgttggctctggcgcgcaggacaaagtttactatctcattacggaaatctttcgggttactgatacccgctggtttttcaattttttccagttcggcgttcagcgactcgcgatcgaacagttgaccggtatctgggtcgcgatactcctgatcctgaatccagaaatccgcataagtcacgtaacgatcaaaaatgttctgcccgtactcagagtaagattcgagataggccgtctggatctccttgccgataaattcggcgtatttcgggatcaggtagcctttcaggaactccagataacgctcagcttgctcctgcgggaactgctcgcgctcgatttgttgttccagaacgtagaacagatgtaccgggtttgccgccacttccgcatggtcgaagttgaatacgcgggagaggatcttaaaggcgaatcgggtggagagaccgttcatcccttcgtccacacccgcatagtcgcgatactcctggtacgatttagctttggggtcggtatctttcaggctttcaccgtcataaacgcgcattttcgagtaaatactggaattttccggctctttcaggcgggaaagagtcgagaagcgcgaaagcgtttccaatgtgcccggcgcgcagggcgcatgagccagctcgctatgattaagtagtttctcgtagattttgatctcttcggagattcgcaggcaataaggcaccttcacaatatagacacggtcgaggaacgcttcgttatttttattgttacggaaagtcacccattcagattcgtttgagtgggcaagtatgatgccattaaagggcagggcggaaataccttccgtaccattgtagttaccttcctgagttgcggtcagcaaggggggcagcaccttaataggcgctttaaacatctcgacgaactccatgatcccctggttagcgcggcatagcgcgccagagtaaccatacgcatccggatcgttctgggcgtgatgttcgagtttacgaatatccaccttgccgaccagcgccgaaatatcctggttgttttcatcgccgggttccgttttggcgatggcaatctgctccagaatggagggccagactttcaccacgcggaatttagtaatatcgccgccaaactcatgcaggtgtttggccgcccacggggacataatcgtaccgagatagcggcgcggaataccgtactctttttccagaatctgcgcgtcttcctgcggattaaacaggcataacggatgatcgttgaccggactacgctcgccgttggcgcttaaaacataaattggcacgcgctgcattagcgatttcagccgttcagcgagcgatgatttgccaccccccacaggtcccagcaaatagagaatttgcttcttctcttccagcccttgcgccgcatgtttcagataagagacaatctgttcaatcgcgtcttccatgccgtaaaactcttcaaacgcaggatagcgagcaataacccggttggagaagagtcgggaaagtcggggttcctgggcagtgtcgaccatattaggctcgccgatagccattaatagccgctctgccgcgttggcataagcactgcgatcttgccgacaaatggtaagaaaatcctgcagtgtgaactcttcgtccttggcagcttcgtaacgctggcgatagtgatcgaatatattcatgatatgccattctttcgttttttcgcacatgttaagagccgttcatatgaatagtagaggctcccggaagaggtagactgaacgccgtctctgctaaggaaaaaaagcaactctcatgccattttattggtcagaagatcaacgtgtccggtgatacaccttcttaacattaagcgtagatggcatttgcaaaacttgcctgtacgcgtcagtgaatttcgatgacatatcaataactcatcaggtagaaaaggctggtggatatcagaaaaagcgttcccggccacataacgatcatcagccgatcatctgaaaataatcggtgatggtgatattaaacggttacattgtgtaaaatagttgggcttacaggtattggcggttacacttttgccgcagaacatttgaataaggaattatggattgtgaccaaacttaaacttctggctcttggcgtgtttattgcaacatccgccagcgtcgcgcacgctgaaagcaacctgacgttgggcgcaggcgttggtgtggttgaacacccttataaagattacgatagcgatgtttatccgataccggtcatcgcttatgaaagcgaaaacttctggttccgtggtctgggcggcgggtactacttgtggaatgacaatgccgataagttgtcaatcatggcatactggtccccgatgtacttcaaaccgggcgacagcgatgaccatcagttgcgtcgtctggacaggcgtaaaagtactatgatggcgggcgtttcttacgcgcaccacacccagtatggattcctgcgtacctcactggcaggggatacgttagataacagtaacggtattgtctgggatctggcctggctgtatcggtataccaatggcgggctgaccttaacgccaggtatcggggttgaatggaatagcgagaaccagaacgattactattacggcgtatcacgtaaagaatcttcgcgtagcggcctgcgcggctataacccgaacgatagctggaacccgtatcttgaactgagcgctaactataatttcgccggtaactggagcgtatatggtactgcgcgctacacccgcctgtcggatgaaattaccgacagcccgatggtggataaatcctggaccggtatcctttctactggcgtgacctatagattctgattgattgaatttgccggaaaaaccatgacaaagcctgcgttatgcgggctttgtgctgtctgaaacgcgaacatggcggcttgcataaatgcgctgttgaccgggtatggcgcagccttacgtgatttatactttgttacatcaatttaaaaaactagccttttatatgaaaaatccaggtgattacaactgcgctaacaattagcgtaataattgttgcaatgctggctgatatcgccctgtcacgtcccgcttatgctatacccattcttcacagcgagtaagacgaatgagcatagtattcaataccgtggccaagcccagcggcagtctgtgtaacttatcctgcaagtactgtttctatcttgataaaccccggggccagcgcgtcatgtctgacgatgtgctggagacgtatatccgccgggtaattgatgatacgccatcatcagaggtctcgttttgttggcagggggagagccgacgctatgcggtctttctttttatcaaaaagtggtgtgcttgcagcaacgctatgccaacggcaaaactatttacaacagtctgcaaaccaatggcgtattaatcaatgaagagtgggcggctttctttgtgcagcaccagttcctgattggtatatcgattgatgggccgcaagtcgttcatgataattaccggagaacgccgtcagggcgggcgtctttttcccgagtcgttaatgctatccgccttctgcaggcaaatgatgtcgagttcaatacgctcactgtcgtgaatgatgcatcatgccgtcatggcaacgctatttatcattttttgacgcaggaactggaaagtaaacacctacaatttattcccattgttgagccgctcgcgcaaaaagcgcagcgttctttgacgttatctgacaatgaagattcgccttcgctgatgcccttttccgtcacgcctgaagggtggggggcctttatgtgcgatgtttttgatcaatggatacgtcacgatgtcggacgcatattcgtacagctttttgataacttacttggcgtctggatgggggagcccgccacgctttgtacgatgcagtcgacctgcgggcaaagtttgctggtggagcagaatggcgacgtgtttagctgtgaccattttgtttttcccgcctataaactgggcaatctgcagcaacactctttagaagaaatggcggcctctccttttcagcagcagtttggcgcggctaaagcaaacctttcttcacgctgccagaactgtacgtggcgctttgcctgtcacggcggttgtccgaaacatcgaatttgtatggacggcggcgaacggcaaaattatctctgtaaaggatatctggagttctttcaacatgtgacgccctatatgaatgtgatgcgtcaattattactgaatcagcgacccgccgcgcatattacccgcatcgtcgacatgattgcggatgacgttcgtcagtgacaagaaaatcgccccccttgcgcggtatgatgccggacattaccgtagggtctaagagtcctgtattgttttaccgtcgagtgaaattgaaaaggaaatgaaatcagtgaaaaacgtaacgttttgcgggcaggtgacgcttcctgccatcggacagggaacatggtatatgggcgagcgcgcggatcaacgtcagcgcgaggtttcggcgctgcgcgcggggctggatttggggttacgccttattgatacggcggaaatgtatgccgacggcggggcggaaaaggtcgtgggcgaggcgttagcagggcgacgcgatgaggcatttctagtgtcaaaagtgtacccgtggaacgctggcggccagaagatagttgccgcctgtgaggaaagcctgcgtcgtctgaaaacagattatctcgatctctatctattgcactgggccggaggcttttcattcgaagagaccgttgaaggtatggagcggctaatcgcgcagggaaaaattcgccgttggggagtctctaatcttgattatgacgatatgcaggcgctgtggcgcatccctgggggacagcaatgcgcgacaaatcaggtgctctatcatctggcgtcacgcggtattgagtatgatttattgccgtggtgtcaacaacagcgaatgccagtgatggcctatagcccgctggcgcaggctggccggttacgtagcggtttactgaatcatccggtggtgaatgaaattgcgcaagcgcataacgcaacggcggcgcaaatcttactgacgtgggtgattgcgcatccgggcgtgatggcgatcccgaaagccggaagtacagaacacgtgaagcaaaatgcggcggcgcttgagattaccttgtcagcaaacgaacttgccttactggacaacgcctggcctgcgccaaaagggaaaaccgcgttggatatggtgtgacgccggataaaatgtgtaagtgccgccatccggcaggtcatgcctgatggcggctggcgccttccagagcctatagcaacgccgttatccattcacttttagcgtttagcgacgcagatagtctgcgccagacgagagggtttttcttctgtggcttgttgcggcgcagtagcgtaaaccgtttcaacgcagacaaacgttttatagccgtcatccggcatgtcgcccatgctgacggacaacgccgggccagggttccagcctacgacgttaaggtgatggtggtggaccacatcaatcgtgcggtttaatgtcgcatcgtggatcacgctacatgcttcaggattgaggtaaacgcgatcggtacggtccggaaaggtttgtataccgtcggctaggacatcttctttagcgtcgttaactttatcaataaaccgatcgccgagtccgctgaccttaacgttggcgatgtcgccaacgttaaaatagctgtggagcgcggatgtggttgcaaattcgccatgcgcttccagttcaatttcacaggttttacccactttaaaacgtgccagcagcgtgaaatcgtgcggccagtatttccgggtggcctcactgctttgcagctcaaatgtcagcattacgccattatcatcttcattatgcgcttttagcgcccacggaagattacgcgcaaagccgtgtgacggcagaccctgttgagccgcaggtccaaaccagggccagcagatcggtacgccgccgcgtagcgccacgccggttttgaaaggcgtattattactgagccacaatacctcttcctcgccaatgggtttctaggagagaaggtgcgcgccctgtaatgcaaaagaggctttaacctgcggatggtcaacgacgatcagatccaggtcatcaagctgacgacgggaaaggacaggggtaagctgttcgataaccgggagggcaaaaattttattaatcattacgcaatcctcttaaccctaaataattcgagttgcatgacaaggcgcttgtgccttgaccagtgcttgcgctggcccgtagaggcgaggccgcaggccgagtaacgcggcaagtgaacgacaaattcatcgggaacgaatttgaacaaccgtaggtaaccttcggtcaggggcatccctgattcatcccgataagttcgacttccgtcagtgattcgggtgagaaagcatagccaacacacctgcaacttgaagtatgacgggtatatctttaagcaaaaaaaagagcgacctgagtcgctcttaccaatgactgtgtcatctcaacttatttggagatgtgagcaatcaggtccagtactttgttggagtaaccggtttcgttatcgtaccaggagaccagtttcacgaagttgtcgttcagcgcgatgcctgctttagcatcgaacacggaagtgcatacttcgccgttgaaatcggtagatacaacgtcgtcttcggtgtaacccagaacgcctttcatttcgccttcggcagcagctttaacagcagctttgatctgctcgtaggtagccgctttttccagacgaacggtcaggtcaacaacggatacgttcggagtcggaacgcggaacgccataccagtcagtttgccattcagttccggcagtactttacctaccgctttagcagcgccagtagaggacgggatgatgttctgagatgcgccgcggccgccgcgccagtctttgtgagacgggccgtcaacggttttctgggttgcggtagtcgcgtgaacagtagtcatcagaccttcgatgatgccgaagttgtcgttgataactttagccagcggcgccaggcagtttgtggtgcaggaagcgttggaaacgatgtcctggccttcgtatttgtcaaagttagcgcctttaacaaacattggggtgttgtctttagacggacccgtcagaaccacttttttcgcgccagcggtgatgtgtttacgcgcggtttcgtcagtcaggaagataccggtagcttcagccactacgtcaacaccaacttcgtcccatttcaggttagccggatcgcgttcagcggtaacacggatttttttaccgttaacgatcagatgaccgtctttcacttcaacagtaccgtcgaaacggccgtgagtggagtcatatttcagcatgtatgccatgtactctgcgtctaacaggtcgttgattgcaacgatctcgatgtcagaacgtttctgagcagcacggaaaacaatgcgaccgatacggccaaaaccgttgatacctactttgatagtcatatattccaccagctatttgttagtgaataaaaggttgcctgtaaaattacaaaaaccttacgcagcgtcaagcggaatcgtgtcaatcattgcgacaaatcaatcctctgcacaacctttgcgcggctgattcgcctcactcttcctttcagcttgaaaccacatgggggcgccgccccgaattttaaagggcaaccgagataataatgtgacatcagtcacgattcgtgagccgccatttcgcaatgatcaagtttagaacaaaagttggtactgaggtgctaatgttttgttagaatcggtcaggcaatgtgagcacgtttaaagtgagatgtgagcaaatggctaaccaaccttcagcagaagaactcaagaaaaaattgtccgaaatgcaattctatgtgacgcaggatcgtggcacagaaccgccatttaccggacgcctgctacataataaacgcgatggggtttatcactgcctggtctgtgatacgccgctttttcactcccacaccaaatacgattcaggctgcggctggcctagcttttaccagcctgtcagcgaagaggcgattcgttacatagacgatttttctcatggcatgcagcgtgtcgaaattcgttgcggtaactgcgatgcgcatctcggacacgttttcccggacgggccgcagccaaccggtgagcgctattgcgttaactcggcctcgctggccttttctgacgagaaaaacggcgatcaactgaaaggctgaaaaaacgattcagcaaattattccacaggagcggacacatcatgaatcttgatgagatcattaacagcatgacgccggaagtgtatcaacgtttatccaccgccgttgagctgggtaaatggccggatggcgtggcgttgacgccggaacagaaagaaaacagcctgcaactggtgatgctatggcaggcgcggcacaataccgaagcgcaacatatgacgatcgatactcacggtcagatggtgatgaaaagcaagcagcagctcaaagcggatttcggtattacgtcaaagccgattgcgacattgaaaatgcagtaacggcagccggataagaggtagtcgccatccggtggtttaattgccaatgcgttgtgcttaccgggcctgctcattgctgtcaggcacaggcccgccatatttttacccattacgcttaatgtccagcgagtccgccaactgtttcgctaactgattattgtcattggcggcctattcccagaacattgcgccggccagcccgcgctttttaatctgtttcgttagaagcgctctccagcctgcgttgagctttgcctggtagcgacgctgacgtgacgtatccggcccaaagatctatgcaatggtctcaccgttgcgtgatgtattgaccggatacgatacctgctccgctacctggcgatagcctggccctgcgtctcttcccagtctgccagcgtatacagcgtcgcgcctgccgccgccatctccataaacgcgtgtgcgctatcctgcgggtgaatattcacgccgcgacagccatcggtgataacgttaacggcatagcccaactctagcgcatccagcaccgtaaattttacgcagtaatcggtcgccaaccccatcacgataagctcggtaacgtcatgctcgcgaagccaggtatcaagggtagttttctgccgatgttcgttgtcaaaaaacgcgctgtagctatcaatcagcgggttttcacctttatagatgcaggcgtcaatcgcatgttggttaagcaggggatgtaacgccgcgccgtcggtatgttgaacgcagtgatccggccagagcgtttgcggcagcccgtccagctttccctgtctatagggttccgcctgatgctggctggcgaagctgccatgctgcgcgggatgccagtcctggctggccagcaccggaatctgccggggctggcaccagtcaataagagcgttggcgatgtcgatggtgctgtcgccttccgctacagccagcgcgccgccggcacaaaagtcattttgcaagtcgaccagtaataaggcccggtttgtcattatcttctccttgtcgtcgggattttttaatcatccggcgtcaattcaccacgcaagttttgcgccatcgcgctacgaatcgcctgagtgtccagaccctggcttaacaaataatgcagtttggttaaggtagcttcgacggtcatatcggcaccgccaatcacgccagcgtgcgccagcgcattaccggtagcgtacccgcccatattgactcgccctgacatgcattgcgtcaggttaaccaccacgatgccgcgcgaactggcctctttcagctcctgtaaaaacgctttattttgcggcgcgttgcctacgccataagagcgcagaatcagcgcttttaccggctgacgcagaaagttacgtactacctcggcggaaatccccggataaatcgtcactacgcctatcggctgcggcgtaatagggtgaacgattaattcaccagaaccgtagggcgcgggaggcgtatttaaacggcgaatgtgaattcctgcttccagcaagggcggcagattaggagaggcaaaagcgtcaaaaccatccgcatgtgctttggtcgtgcgattgccgcggaacagacgattattaaaaaacagcgttacttcattaacagggtagttggcggcgacataaagcgcattcagcaaattaatttgcccgtcggagcgcagctcagccagcggaatttgtgaccctgtcacaataaccggtttacccagattttccagcatgaaagagagcgccgatgcggtatacgccatcgtgtcggtgccgtgcagaataacaaaaccgtcatactcatcgtagtgcgctttgatatctgcagcgatatgctgccagtcttccggcgtcatatctgatgaatccatcagcggggcatattcatggatggtaaaatccggcatctccgggcggtggaattccggcatcagcgccagctgacgctgaaggcgcccggacaccgggatataccctttatcggagcgctgcataccgatagtaccgccggtataggcaacgtaaattgatttcttttgcatgataatgttcagtcgtgtcgcgaaggacgtattaatgattatcggatggcggctatgagcagacgccgacatccggtatggctattgatgaagcattagcgcacgttcgcgcaagtcaaacagaacgcataacggttttgtggatcgttaaatgccgccagtttatccccctcggccttcaccgtgttggcggcggaaacgagcggcgccgggagcatcgcctgaatggcctccggcagcatggcgcgtacagatccggtcatactgtccatgaccatatcaaggactgtcggttcgtcctgatagtaatcaagatgccactgtttcagtttcgccagctccgccgctttggcgacggcgtcgtcaaagtcgccgagactgtccaccagaccattggctttcgcgtcttctccggtccagacatggccttgagcgattttgtcaatctgctccggcgtacgcttacgcgcgtctgccaccagcgtgataaagcgtttgtagccgtactcaatactgagttgcatcatctgctgcacttccggtgacagcgctttagtcatcgaaatatccgccagcggcgaggtggaaacgccgtcgctgtgtacgccaatcgacgacaggctgttttctaccgtattaattacgccgaagatgccaattgaacccgtcagcgtgctggggctggccacgatatagtttgccggcgtagagatccagtaaccgccggaggccgccatgccgcccattgagaccaccaccggtttgccagccgctcttgccgccgccagttcggcgcggataacttcggaggcgttgacgctaccgcctgggctattgacgcgcagcacaatcgctttcactttaggatcaaggcgtgcgtcgcggatctgcgatgccgtagtgtcgccgccgacattccctggcgtttcttcgccatccataatcgcgccattggcgaaaataaccgcaatagtaccgccggtatccgcaggcgttttcagcgaataatcgtaatagctgatcgcgcgatagttattttcggttttgctccagccaaactgcttcgtcagcgctttttcaacatctgcgctggaggcgagggcgtccaccagtttatggtcgagcgcatatttggcggtgtcaccgcccacgctggttaacccgtcgataatagcctgggcgccggggaagagttgttgcggcgaaatctggcgattggcggaaacggtatgcaggtagttctgccacagttcgcctatccagcggctgtcggcctcgcgggcggcgggcgacatatcgtcgcggataaacggctcgacggcggatttataggtgccgacccggaaaacgtgggtagagactttcagtttatccagcagcgttttgtagtacaggccattcgtagcgaagccgtgaagatctacctgaccctgtggggaaagccaaattttattggcgaaactggcgaggtaatactgaccctggctgtagttttcacccacggcgaaaaccggtttgccgctatcgcggaattcgcgcagcgctttaccgatatagcgcattgacggctgatcggcaccggtgaagtttttcagatccagaacgatacccgtgatgttacggtcatctttcgcctgacgaatagcgttgacgatgtcaaacagggagttttcctgcagacggtcggagctggcgccaaataactggcgtcccagcgcgcccagacggtgattggtggagggtttatccacaatgacgccggaaatatccagcagcaaagcgccgcgcgccgtttgctcactgttgctgccgttaccgatctgcatccagatcccaacgcccaccaggaccagaaaaataaagaacaggttgagtaccatttcacggacgaagttcaacactcgccacgtccatttaaaaaatccggcaataaatcgccacagggttcgcatgtattctccctatctgagtaacaacgcttataccttggtgaggataaagcattaagatgtggctatcgtaatgacccatcaggcagttgtcagcaggaatcactgcctgcgctgtaacaaaatccgctcccgtgttaattttgtgaataaatatcattgctggagttaatcaaatggatgcactagaactgctggtcaaccgtcgcagcgcctctcgtctcgcagaaccggcgcctgtcggagagcaattacagaacattctgcgggcgggaatgcgtgttcccgatcataaatctctacagccgtggcgtttttttgtgattgaaggagaggggcgcgaccgcttcagcgccgtgcttgaacaaggcgctgtcgctgccgggggggatgagaaagcgatcgaaaaagcgcgtaatgcgccgtttcgcgcgccgctgatcattaccgtggtggcgaaatgcgaagaaaaccataaggttcccgtgtgggaacaggagatgtctgccggatgcgcggtgatggcgatgcaaatggcagcgattgcgcaagggtttaatggtatctggcgtagcggcgcattaacggagagcgctatcgtgcgggaagcctttgagtgccgtcctcaggataaaattgttggttttctctatctcggcacgccgcagctcaaagcgtcaacgacgatcagtacccccgaccccacgccgtttgtgcgttatttctgacgctgagggataaaactgtctggattctgagcaaaggcgcggtaattcagacagtgatacttaccacatcagggaatgagcgctaccatagcgcgaatgcaatgacaggagatgtccatgagcaagcaagccattcgtttaacgcaatacagccacggcgctggttgcggttgtaaaatttcccctaaagtgctggagactatcctgcatagcgagcaggcgaagttcgtcgacccgaatctgctggtgggtaatgaaacccgcgatgatgcggcagtttacgatctgggtaatggcaccagtattatcagcaccactgacttctttatgccgatagtcgacaacccgtttgattttggccgcattgcggcaacaaacgccatcagcgatatttttgcgatgggcggcaaaccgattatggcgatcgcgatccttggctggccgattaataccctgtcgcccgatattgcgcgtgaagtgaccgagggggggcgttttgcctgccgtcaggccggtatcgcgctggcgggcggacactctattgacgccccggagccgatctttggtctcgcggtcacaggcgtagtgccgaccgaacgggtgaagaaaaacagtaccgcgcaggcgggatgcaaactctttctgaccaaaccgttggggattggcgtgttgaccaccgccgagaaaaaatcgctgcttaaacctgaacatcaggggctggcgacggaagtcatgtgtcggatgaacgttgctggcgcggcgtttgccaatatcgacggcgtaaaagccatgactgacgttaccggttttggtctgctgggacacctgagcgagatgtgccagggtgcaggcgtacaggcgatgctttgctatcaggacatccctaaactgccgggcgtggaagagtatattgctctgggcgccgtaccgggcggcacagagcgcaacttcgccagctatggtcatctgatgggcgacatgtcgcgtgaagttcgtagcctgctgtgcgatccgcaaacgtcaggcggtctgctgttggcggtaacgccggacgccgaagacgatgttaaagccaccgcggcggaatttggtatcgaactgaccgcgattggcgaactggtcgaggcccgcggcggtcgcgctatggttgagattcgttaacctgatgcggttgtttattgccgaaaaaccgagtctggggcgcgccattgcggatgtgctgccaaaaccgcaccgtaaaggcgatggttttattgagtgcggaaacgggcaggtcgtcacctggtgtattggtcatttgctggaacaggcgcagccggatgcgtatgacagccgttatgcgcgctggaatctggctgacctgcctatcgtgccggaaaaatggcagcttcagcctcgtccttccgtcaccaaacagctcaatgtgattaagcgctttttgcatcaagccggtgaaattattcacgccggcgacccggatcgcgaagggcagcttctggttgatgaagtgctggattatctccagcttcctgccgaaaagcgccagcaggtacggcgttgtctgataaacgaccttaacccgcaggcggtcgagcgtgctatcgacaggctgcgggcgaacagcgacttcgtgccgctgtgcgtctccgcgctggcgcgagcgcgagcggactggctgtatggcattaatatgacccgtgcttacacgatcctgggccgtaatgccggctatcagggcgtgttatccgtgggacgcgtgcagacgccggtactggggctggtggtgcggcgagacgaagagattgagaacttcgtcgccaaagacttctttgaagtgaaggcgcacatcgttacgcctgccgacgagcgttttaccgctatctggcagccgagcgaggcgtgcgaaccttatcaggatgaagaggggcgtttgcttcatcgtccgctggcggagcatgtggtgaaccgaatcaacggtcagcctgcgctggtaaccagttataatgataaacgggaatcagaatccgcgccgctgccgttttcgctctcgacgctacagattgaagccgctaaacgttttggcctgagcgcgcaaaacgtgcttgatatttgtcagaagctatatgaaacccacaaactgattacctatccgcgttccgactgccgttatctgccggaagaacactttgccggacggcaggcggtcatgaacgcgattagcgtccacgccccggatttactgccgcagcctgtggttaatcctgatacgcgcaatcgctgctgggatgacaaaaaagtggatgcgcaccacgcgattatcccgacggcgcgcagttcttctgtccatctgacggaaaacgaagcgaaagtgtacaccctgattgcgcgtcagtatctgatgcagttctgcccggacgcggtgtttcgtaaatgcgttattgaactggaaatcgccaaagggaaatttgtcgccaaagcgcgttttctggcggaggccggttggcggacgttactgggcagtaaagagcgcgacgaggaaaacgacggtacgccgctgtcggttgtcgccaaaggtgatgagttgctgtgtgaaaagggggaagtggtcgaacgccaaacccagccgccgcgtcatttcactgatgcgacattgctttccgcgatgaccggaattgcccgcttcgtgcaggataaagatctgaaaaagatcctgcgcgcgaccgatgggctggggacggaagccacgcgcgccgggattatcgaactgctgttcaaacgtagctttctgaccaaaaaagggcgctacattcattctaccgatgctggcaaagcgttaatacattcgctgccggagatggcggcccgtccagatatgaccgcgcactgggaatctgttttgacgcaaatcagcgaaaagcagtgccgttaccaggattttatgcaaccgctggtcggcacgttatatcagctgatcgatcaggctaagcgcacgccggtgaagcgtttcagagggatagtcgcgccaggcggcggagaaaagaaaaagagcgcgccgcgtaagcgagcgggcaaaaaaagcccgcctgctgaggagacaggccgtcagaccgaataagcgtaaagccatctggcctggcgacgggattaaatgacgccctgcgccagcatggcgtcggcgactttcacgaaaccggcgatgttggcgccctgaacgtagttagtatgcttattgtcgccgccgtacttgacacaggcgtggtggatatccagcataatatgatgcagacgggcgtccactttctcggctttccagctcaaccgcgcggcgttctgcgccatttccagccccgatgtcgccacgccgcccgcgttggcggctttacccggcgcaaacagtacgcccgcctcaaggaagagatcggtcgcttcaatcgtggttggcatatttgccccttccgccacggctttcacgccattggcaatcagtacgcgcgcggcgtcaacgtccagttcgttctgcgtcgcgcatggcagggcgatatccaccggtacgctccagggctgctggccttccagataggttaagccaaactcacgggcgtagtcagcgacgcgaccgtcacggctggctttaatttcacacagccgcgccagcttctctggcgtgaagccactttcatcgaccaccgtcccgctcgaatccgacgcggtaaccacgcgcgcgccaaaggccatcgctttctcaatggcgtattgcgctacgttgccggagccggacacggcgacgcgcatcccttcaaaaccgagaccatgacgtttaagcatcgcttcggtgaagtagaccaggccatagcccgtcgcctccggacgaatcaggctgccgccgaaggaaagccctttgccggtgaagacgcaggcgctgttattggaaagcttgcgcatcattcccgccataaagcccacttcgcgcccgcccacgccgatatccccggcaggcacgtcggtatccggccctaaatggcgatacagttcagtcatcagcgcctggcagaaacgcatcacttcgccttcgcttttccctttcggatcgaaatcgctgccgcctttaccgccgcccatcggcaacgtggtgagggcatttttaaaggtttgctcaaagccgaggaacttaaggatggaaaggtttaccgaaggatggaagcgcataccgcctttataggggccgatagcagagttgaactgcacgcgccaggcgcgatttacctgcacctgatttttatcgtccagccacactacgcgaaactggattacgcgctctggttcaaccaaacgttccagtaaagacatgtggcggtaacgggggttttgttcaagaaacggccacagggtggtcatgacttcacggacggcttgcgcgaactcggtttgatgcgggtcgcgcttttgtacatggttgaggaacgattccagagaacatgtctgatccatagatataaaaacctcttatatattaatgtggttgtatttgcgttttatcagaatatgtatttgcagttttcgactataccatcagcaatgtgacggtaagcaagaaaaaaatgacgctgctaagtaaattcataacggggagagggtcataactaaaagcgatgacaaaagaggattaaagttttcacggcggcttaccgttatactgagaatatacttggaaaaataaggaaatcctatgcgccgaagcctcatggtcgccgtgatggcgataatgccaatggtcgggctggcaaaccaaaacagtcgtcctgatattcaggtgaatgtcccgccggaagttttcagcacgcgcggtcagtcatcccagccctgcattcagtgctgcgtttaccaggatcagaattactccgaaggcgcggtaataaaagtggaaggcgtcgtgctccagtgccagcgtgacgaaaaaaccatcagcacaaatccgttagtctggcgtcgcgtaaagccataaacgcctgcaatagcggaatatccgccggggcgagggggtattccagcgcctcttccggcgtacaccaggctaaggcctgatgttccagcgcacgtatcagaccgttaaacgcaggcacatgccaggcgtgcaaatgaattcgtcggccagacacgtcgcgttgatggctggcgatatagacgccgggcgtggcgtcaatccctaactcttcgcgtagctcgcggataagcgcctgcggttgggtttcgccgggttcgactttaccgccggcaaactcccataaaccggcttgatccgcatgaactgggcgctgggccagcagtattttgccgtcgcgttcaatgatggcggcaacaacatcgagtttttttatcattgtcgttaaggtcgttattcctgccgggaagcgtcgcgctatcccggccttacggttaatcagatagcggaatcaaacacgaaacgtcgcccagaccggcgcatggtcggagggtttttccatactgcgaatgtcgtagtctataccggtttctgcgcaacgttccgccagcggagcgcttgccagcaagaggtcaatgcgcagtccgcgattatccacgaaaccttttgaacggtaatcaaaccacgaaaatttatccatcgtttgcggatttgcctgacggaacgtgtccactaatccccacttcagtaaccgcgacatccattcacgctcctccggcaggaaggagcatttaccggtacgcagccagcgtttgcggttctcttcgccgatgccaatatccaggtcggtcgggctgatattcatgtcgcccataattaataccggattatcgcacttgagttccgtttcaagatagttttgcaagttctgataaaactgcgctttcgcggggaacttcaacggatgatcccggctttccccctgcgggaaatagccgttaatgacggtgatattacccagcggcgaggggatttccgccatgataatgcggcgttgcgcctcttcgccatcatccggaaaaccgcgtctgacggaaatgggcgtggcttttgttagcagcgcgacgccgtaatggcctttttgtccatgatagaaaacgttatagcccagcttcgcgacctcttcgagcgggaacatttcgtcgtggacttttgtctcctgtagaccgatcacatcgggctggtgtttttcgacaatcgcttcaagttgatggggacgggcgcgcaggccgttgatattaaaagagacaaatttcatagtcactgccactttgcaaggtgaatcgtgttgggatggtagcagaaattttaccgggtgactgccactcatcgtcagattcggccaatggaagcgtatggtgttttctatagcgcgaaaatggcacggtttgcgtgcagatgcgccagaacggggcggtaatttccagtaaatttcgtataagatcacaattccagaattatatttggcaactgaataatatttcgctttttcctctttctagccaccgattatgcggaaatattcacttttcatgcagtaaaagtgaatatcgctacgctgtaacccattgatttaccgtttatcacttctgtttatgcaatgttaacgctggctggcacgaatgctgcaatctacatttacagcgcaaacacccatattaattaacatatagataactttatttttaccaaaagaggtcgctatgtctctgtcagttacgcgcgaaaactttgatgaatggatggtgccggtatatgttcccgcgccttttattcctgtacgcggagaaggctcacgcctgtgggatcagcaggggaaagagtacattgattttgctggcgggattgcggtcaacgcattgggacatgcgcatccggcgctgcgcgaggcgttaaatgaacaggcgaatcgcttctggcataccgggaacggttacaccaatgaaccggcgctgcgactggcgaaaaaactgatcgacgcgaccttcgccgaacgcgttttcttttgtaattcaggcgctgaagcaaatgaagctgcattaaaactggcgcgcaaatatgcccacgatcgtgttggcaaccataaaagcggcattgtggcctttaaaaacgcgttccatggccgcacgctctttaccgtcagcgctggcggtcaacccacctattcacaggactttgcgccgctgccgccggatattcgtcatgcagcctataacgatctgaactccgccagcgcgctcattgatgacaatacctgcgccgtaatcgtagagcctgtgcagggcgagggcggcgtgatccccgccacgaacgcttttttgcaggggctgcgtgaattgtgcgaccggcatcaggcgttactgatttttgatgaggtgcagacgggcgtcggacgtaccggcgaactgtatgcatatatgcattatggcgttacgcccgatatcctgacgaccgctaaagcgttgggcggcggcttcccgatcggcgcgatgctgactacgcaagactatgccagcgtcatgacgccaggtacgcatggcaccacctacggcggtaatccgctggcgacggcagttgccggaaaagtactggatatcatcaatacgccggagatgcaaaacggcgtcagacagcgccacgatgcgtttattgaacgtctaaataccattaatgtacgttttggcatgttcagtgaaattcgcgggctggggctactgcttggctgtgtgctacagacggagtttgccggaaaagccaaactcatcgcccaggaagcggcaaaagcaggcgtgatggtgctcatcgccggtggcgacgtggtgcgttttgcgccagcgttaaatgtgagcgacgaggagatagctaccgggcttgatcgttttgccctggcgtgcgaacgccttcaggcgggaggcgcatcatgcgggtgattcgtcctgtcgaacatgcggatatcgccgcgctgatgcagcttgcaggcaaaacgggcggcggcttaacctcgctactggcaaatgaagcgacgctggcggcccgcattgaacgcgcgctaaaaacctggtccggcgagctgccaaaaggcgaacaaggatatgtatttgttctcgaggacagtgaaacgggtgaggtcggcgggatctgcgccattgaggtcgcggtcggccttaacgacccttggtataactatcgtgtcggtacgctggttcatgcttccaaagagctgaatgtatataacgcgttgccaacattattcctgagtaatgatcataccggcagcagtgagctttgcacgctgtttctcgatcccgaatggcgtaaagagggtaacggctacttgttgtcaaaatcgcgctttatgtttatggccgcgtttcgcgataaattcaatgagaaagtggtggcggaaatgcgcggtgtcattgacgagcatggttattctcccttctggcaaagtctcggcaaacgcttttttctatggatttcagccgggcggattttttatgcggtaccgggcaaaaagcgtttatcgccgagctgatgcccaaacatcctatttatacccacttcttatctgaagaggcacaggccgtgattggcgaagtccacccgcaaacggcgccagcccgcgtggtgctggaaaaggaaggctttcgctatcgccactatatcgacatcttcgacggtgggccgacgctggagtgtgatattgaccgcgtgcgggctattcgtaaaagccgactggtggaagtcgcggaagggcaacccgcgcttggcgactatcctgcatgtctggtcgccaatgaaaactatcaccactttcgggccgcgctggtgcgtgccgatccgcagacttcacgacttgtacttaccgccgcgcagttggatgcgctgaaatgtcgcgcgggcgaccacgttcggctggtacgcctttgcgctgaggagaaaaccgtatgacgctatggataaacggcgactggataaccggtcagggcgaacgccgccgcaaaacgaatccggtgagcgaggagatactttggcaggggaatgacgctgatgcggcacaggtcgccgaggcctgtcaggcggcgcgcgcggcgtttcctcgctgggccagacagccttttgcggcacggcaggctatcgtagagaaattttccgtcctgctggaggcgcataaagccgatctcacggaggtcatcgcgcgtgaaaccggtaaaccgcgctgggaggcggcgacggaagtgacggcgatgatcaataagattgccatctcgattaaggcttaccatgccagaaccggcgaacaaaaaagcgaacttgtcgatggtgccgcgacgctgcgccatcgtcctcacggtgtgctggcggtattcggcccttataactttcccggccatttaccgaatggccatattgtgcccgcgttgctggcaggcaatacgctgatcttcaaacctagcgagctaacgccatggaccggggaaacggtaataaaactctgggaacgggcggggttaccggcaggcgttcttaatctggtgcagggcggccgggagaccggacaagcgctgagttcgctcgacgatctcgacggactgctgtttaccggcagcgccagtaccggatatcagcttcatcgtcagctatccggccagccggaaaaaatcctggctcttgaaatgggcggaaacaacccgctcattattgaggatgcgacaaatatggatgcggcggtacatctgacgctgcaatcggcgtttattaccgccggacagcgctgtacttgcgcgcgacgccttctggtaaaacagggcgcgcagggagatgcatttctggcgcggctagttgacgtcgccggacgtctgcagcccggcagatgggacgacgacccgcagccgtttatcggcggactgatttcagcgcaggcggcacagcatgtgatggaggcctggcgtcaacgagaggcattaggcggtcgcacgctactggcgccgcggaaggtcaaagagggaacctctctgctgacgcctggcatcattgagctgacgggcgtcgcggatgtgccggatgaagaggtgtttggtccgctgctgaacgtctggcgttatgcgcatttcgatgaggcgattcgtctggcgaataatacccgttttggtctgtcgtgtgggctggtgtcgacggatcgcgcgcagttcgaacaactcttgctggaggcgcgggcagggatcgttaactgaaataaaccgctcaccggggcagcgagtactgcgccgtttggtggtgtcggcgcgtctggcaaccatcggcccagcgcctggtatgccgccgattattgcgcctggccgatggccagtctggaatctcccgaactgacgttgcctgcgacattaagccctggcctcgacttttctcgcagggaggcggtatgacggcgcatgaagttaattttgacgggctggtggggcttacgcaccattatgccgggctatccttcggcaatgaggcatcgacccgccaccgttttcaggtgtcgaatcctcgtctggcggtaaagcaggggctgctaaagatgaaagctctggcggatgccggctttccccaggcggtgatcccgccgcatgagcggccctttattccggcgttacgtcagctcggcttcacgggtagcgatgagcagattctggataaggttgcgcgtcaggcgccacgctggctttccagcgtgagttccgcgtcgccaatgtgggttgcgaatgcggcgacggtttgcccatcggcagacgcgctggacgggaaagttcacctgacggtggcgaatttaaacaataaatttcatcgcgctcttgaggcgcctgttaccgaagcgctgctacgcgccatatttcgcgatgaaagtcagttttcagtgcatagcgcgttaccgcaggtcgcattattgggagatgaaggcgcggcgaatcataaccgtcttggcggcgagtatggttcggcaggcgtgcagctttttgtctatgggcgcgaagaggagaatgaaatacgacccgctcgttatccggcgcgccagagccgcgaagccagcgaggccgtggcgcgtcttaatcaggtgaatccgcaacaggttatcttcgctcagcaaaacccggaggtcatcgatcaaggcgtattccataatgatgtcatcgccgtttcgaatcgacaggtattgttttgtcacgaagcggcgtttgcccggcagaaagtgctcattaatcagttgcgtacgcgcgttgacggttttatggcgatagaggtgcccgccggagaggtttctgtatcagatgctgtggccacctacctgtttaatagtcagttgttaagccgtgacgacggctcaatgctgttagtgttgccgcgggaatgtcaggaccatgccggcgtctggcgctatctgaataagctggtggcggaggataaccccatcagcgcgatgcaggtgtttgatttgcgagaaagtatggccaacggcggcggcccggcctgtctgcgattacgcgtggtgttaacagaagaagaacgacgggcggtgaatccagcggtaatgatgaatgacgctctgtttacggcccttaacgcgtgggcggatcgttattatcgcgatcgcctgaccgctgccgatctggccgatccgttattattgcgagaaggccgggaggcgctggatgtgttaacgcgtctgctggatttggggtcggtttatcctttccagcaaacgggggcggctgatggataactttctggcgttgacgctaagcggcacgacaccacgggtgacgcaggggaagggcgcgggttttcgctggcgctggttaggccatggtctgcttgaactcacgcccgatgcgccggtcgaccgcgcgttaattctttctgcggggatacacggtaatgaaaccgcgccggtcgagatgctggataagctgctgtcggcgctgtattcaggcagcttgacgttaacgtggcgagtgctggtggtactcggcaatccgcaggcgctggcggcgggaatacgctattgtcacagtgatatgaaccgtatgtttggcgggcgttggcagtcctttgccgaaagcgatgaaacgcggcgggcgcgtgagctggagctaagtctggagaccttcttttcatctggccaggcgcgggtacgctggcatctggatctgcataccgccattcgtggctcgcatcatttgcgttttggcgtattgccgcagcgcgaccgcccgtgggaggcggattttctggcgtggctgggcgcggcaggactggaggcgttggtatttcatcaggcgcccggcggtacgtttacgcactttagctctgaacatttcggcgcgctttcctgtacgctggagttgggaaaggcgttgccgtttgggcaaaacgatctgacgcagttcagcgtaacctcgcaggcgttgtcggcgttgctgagcggtgtcgaaacgtcaacctcgttttcgccgccgctacgctatcgggtggtgtcgcaaatcacgcgtcacagcgacaagttcgcgctttatatggatgcgcaaacgctgaattttactgcctttgcgaagggaacgttgctggccgaggagggggataagcgcgtgacggtgacgcatgacgttgaatatgttctctttcctaattcctctgtcgcctgcggattgcgggctggattaatgctggaaagactgccctgataaatgtccctgtaagctcacgttaggattacagggatgatttgggacacagtttcatgctattacggattattcctagagaattgctttattaataagcgttgctgcgttatagttctgcataatttctgctatatcatgctgttgtatatttctctttcaactctgcgcaatttattctttttttcttcacaattggcgaaaaagtgttttttatactttcattgttttaccgttgttctgactaattgacgctaagacggttaaagttaatcacgacaacacggcgctgttttaaatatgccgtaaaaataactgaaaggaaggatggaaatatgcgtaaactgactgctctatttgttgcctctaccctggcgatgggtgctgcgaatctggctcatgccgctgagactaccaccgccgcgccagcggatgcgaagccaatgatgcagcataaaggtaaatttggcccacatcacgatatgatgtttaaaaacctgaacctgacagacgcgcagaagcaacaaattcgcgacattataaaagcgcagcgcgagcaaatggaacgtccgctgctggaagagcgtcgcgccatgcatgatattattgccagcgataccttcgataaagccaaagccgaagcgcaaattacgaaaatggaagcacagcgcaaggccaatatgctggcgcatatggaaacccagaataaaatttataacgttctgacgccggagcagaaaaagcaatataacgctaattttgagaagcgtctgacagaacgcccggcgcaagaaggtaaaatgcctgctgcggcagaataactttccgcataatttaagaccgccggtcttgtcgacaacacaatcgttgaggtggacaggatcggcggttttctttatgactggcgacagtcggtgtgcagttcaatgatctcatattgacctgacattagtggcttacagagaattttatagccatcctgatcaaagcccgcaggggtgcgcaccagggtggcggcctcatccagcgagggtaccgcccccagccataaccagttgttgataatgtggaactgggtcatttgtgggcggctctcttttaacgcgatagcgcctttccagggccagcaaaccacacgtaaccgttccagtgaggcctgcagacgaagaaaatgcgcctgcggggtttcttgcccacaacacgcgccagcgcagcgcttcagcgcgaaacgaaaacaggcgcgcccacggcttaccggttcaagccccagcaggccataacacaatttttgttcatcggcgaggttctgtaagctttgcagcgctgcccgacggttggcgaagagtccaaacaggttcggctcatgggaaaaatcgacgctgcgggcggaaacgacctcaatcttttgttcgctcaactgtagagagcaaagctggcgattacgacgtaaccgcttgttaaacagcggctgttgttctttgatcagtcgcgcctccagcagcaacgcgcccatttccccagcggtgcagatccagcttatccgccgcgcctgtcgcagcatagcggcctcgtcaggcgttcgcagatgtgagagcacccggctgcgaatatttacgcttttaccgatataaagcggcagcgtatcgctttcgctatgaaatatatagacgcccggtaaggctggcgcttcgctgaggaaaggacgtaaatgttctggatattcgtaaatggccgctgcttcaaactcaaggcggggggctgattgacgccgtaccacagtgatctccgttaactggttattcatccagtataacagcggatgggtgattaaaaaagaggctgggaagagaggaggccggatagacgagcgatatccggcacaacagtagaagtacgcttactttttccaaaagtcgtcgaataccgtaatcggtaaacggcgcttatgttcagtttttacgtaccagccttcgatagttttagcgatggcggagtccagcgttttgccttccaggtaatcgtcaatattgtcatacgttacgcccagcgcggcttcatcaggcagtgaagggcggtcgtcttccaaatcggcggtggggacttttttatacagatgctcaggacagcccagcgctgcgagaagctgtttgccctggcgtttgttaaggcgatgaagcgggttaatatcggtaccgccatcgccatatttggtgaagaacccggttatcgcttccgccgcatggtcggtgcccaccacgacgccgtgagtcataccggcgatgctatattgcgctttcattcgctcacgcgctttttcattgccgcgaacaaaatcgctcagctcaattcccgcttcgcgcagcgcctgttcgctggcgaggacggcgcctttaatattgacggtgagtactctgtccggctgaataaaagcaatggcgtcctggcaatcctgttcatcggcctgcacgccataaggcagacgaacggcgataaactgcagcgcattatcaccggtctcttcccgcaattcggtgatagccatctggctgagtttcccggccagcgtcgaatcctgcccgccgctgatgcctaacaccagcgatttcaaaaagggataggttttcaggtacgctttaagaaaatccacgctgcggcgaatttcttcttcagggttgatatgcggtttcgcgccaagcgcctggattatctcttgctgcagagtcatttaacccccttcgacattaaaaaatgaatctttaccctgttaaagctaacccttcgccgctgaaacgacaaggtttggcgggctaagcggtgtttaaaacaacatatcgctgcgttagagaattttccgaaagactttttgtcgcgaggcgcggcttgaaaaatgttctgatgtattccaggcttacataacacgctgataaacaagaggacggaaaatgaacaagaacgtagcaggaattttaagcgcagcggcggtaatgactatgctggcaggctgtacggcgtatgatcgtacaaaagaccaatttgttgagcctgtcgttaaagatgttaaaaaaggaatgagcagggcgcaagttgcgcagattgcgggcaaaccgtcatctgaagtgagcatgattcatgcgcgtggtacctgtcagacctacatcctgggtcaacgtgatggtaaagcggaaacctactttgttgcgctggatgataccgggcacgtgattaactccggctaccagacctgtgcggagtacgacactgacccacaggcgccgaagcagtaacaactgtacattgcctgaacattcaaggaaaccggcctgcgagccggtttttttgtgcctgccataaccttatttattatcgcgaattatttgcccgaaatgtgaggggggtcataacgccaggtcaatgagagacaatttagtaggtcaaggaaataccatccggcggtccgatcccgtatactcatttcagccacctaaaaaagtaaatccggttacgcaagtcgcccagagtatggatgcaggttgaggcttgcggcgtatctggttgacagataatcgcacatgaggaaggtttttatggaaaagaaacacatttatctgttttgttctgcgggcatgtcaacatcgttactggtatcaaaaatgcgcgctcaggctgaaaaatatgaagtgccggtgattattgaagcattccctgaaaccctggccggtgaaaaaggcccggcagcggacgtcgtgttattaggcccgcaaattgcttatatgctccccgaaattcagcgtttattacccggtaaaccggtagaagtcattgattcaatgttgtacggcaaggtagatggcttaggcgtgcttaaagctgcggtagcggcaattaaaaaagccgccgcgaattaattattttttaatttttcccgtcaaagagttatttcatacactaaccgcaatattttattgcggtatttaagggtatttttctatgagtaacgttattgcttcacttgaaaaggtactccttccttttgctgtaaaaataggaaagcagccacacgttaatgcaatcaagaacggctttattcgtttaatgccattaacccttgcgggggcgatgtttgtattaattaataacgttttcctgagctttggggagggggcgtttttttattccatgggcattcggcttgatgcctcaaccattgaaacacttaatggattgaaaggcatcggcgggaacgtctataacggcacattgggcattatgtcgctcatggcgccattttttatcggcatggcgctggcggaagagcgcaaggttgatgcgctggccgccggactgctctccgtggcggcatttatgaccgtaacgccgtatagtgtcggcgaggcctatgccgtaggcgctaactggctgggcggcgcgaatattatctccggtattattattggcctggtggtcgcggagatgtttacatttattgtccggcgcaactgggtgattaaactaccggacagcgtaccggcttcggtgtctcgttcattctcagcattaattcccggctttattattctctctattatggggattattgcctgggcgctgtctaattacggttctaacttccatcagattattatggacactatctctacgccgctggcatcgctgggtagcgtggtagggtgggcatatgtcatttttgtaccgctgctgtggttctttggtattcatggttcgctggcgctgaccgcgctggacagcggcatcatgacgccctgggcgctggaaaacatctctatttaccagcagtatggctccgtcgatgcggcgctggaagccggtaaaacgttccatatctgggcgaaaccgatgctggattcttatatcttcctcggtggtagcggcgcaacgctgggtctgatcatcgctatcttcctggcatcccgtcgcgcggactatcgccaggtggcaaaactggcgctgccgtcaggtatcttccagattaacgaacccatcctgtttggcctgccgattattatgaacccggtgatgtttatccccttcattctggttcagccgattctggcggcgattacgctggtggcttactatttgggtattattccgccgattaccaatattgcgccgtggaccatgccaaccgggctgggggcgttctttaacaccaacggcagtgtcgccgcgttgctggttgcgctatttaacctggcggtcgctaccctgatttatctccccttcgtggtggtggctaacaaagcgcagaacgccatcgagcaggaagaaagcgaagaagatatcgctaacgcactgaaattctaaactccgcgtcggcatgggatgccatgccgggctgaatcagaggaaagactatgtttgatcttgaaaatgttgtagataaccagacagcggctgaggaactcgaagaagtcgttatggggcttatcatcaattctggtcaggcgcgcagcctggcatatggcgcgctcagaaaagcgaaagaaggcgactttgaggcggcgaaagcgatgatggaccagtcgcgcatagcgctcaatgaagcgcatcttgtgcagacaaaactcatcgaaggcgatcagggcgaaggcaaaatgaaagtcagtctggtcctggttcacgctcaggatcatttgatggcctcaatgctggctcgtgaactgatcgctgagttgattgagctccatgagaaactgaaataacagggggcggatgatgcagctacaggttaacgcaacggaaatcaaaacggtttatgagcagcagctcttcaatggcaaaaatttccatgtgtttatctataacaagacggaaagcgtcaccgggctgcatcagcacgactattatgaatttaccctggtattaaccggacgttattaccaggagattaacgggaagcgtgtgctgctggaacgtggagattttgtttttatcccggtggggtcgaatcaccaaagtttctatgagtttggcgcaacgcgtattctgaacgtaggaattagtaaacgtttttttgaacagcattatcttccgttactgccgttttgttttgtggcatcgcaggtatacagggcgaatagcaccttccttacctatattgaaacggtgattgcgtcgttgaattttcgcggcaatgggctcgacgaatttatcgaagtggtgacattttatattataaaccgcttacgtcattaccgcgaagagcaggtttatgatgatattccacaatggctgaaagcaaccgtggagataatgcatgataaaacgcagtttggcgaacatgcgctggaaaatatggtgcgcctgtcggcaaaatcccaggagtatctgacgcgcgccacccgacgttattacagcaaaacgccgatgcaaatcattaatgagattcgcattaattttgccaagaaacagttggaaatgaccaactattcggttacggatattgcttatgaagccgggtacagtagtccaagtctgtttattaaaacgtttaagaagatgacctcattcacgccgaatagttatcggaagcgattgacggaaattaatgagtaacggtttacattgctcgattagttacatttcacgcttgccccaatagcgcggggaacgtcacgctatttcttacgagcgggcatagcgtaatacatatcagtgtcatacactgaagggagatattatgagccagaaattaaaagtcgtcactattggtggcgggagcagctacacccctgaattacttgaaggctttattaagcgctaccatgaattacctgtcaccgaattatggctggttgacgttgaagacgggaaaaagaagctgggcattatttatgatctctgccagcgaatgattgataaagcaggcgttccgctaaaattgtataaaacgctggatcgccgggaagcgctgaaaggcgctaattttgtcactacccagctacgcgttggtcaactcaaagcccgtgagctggacgagcgtatcccgcttagccacggctatctggggcaagaaaccaacggcgctggcggtttatttaaagggttgcgtaccattccggttatttttgacatcattaaggatgttgaagaattatgtccgaatgcgtgggtcattaactttactaacccggcggggatggtgacggaagcggtttatcgtcataccaactttaaaaaattcatcggcgtatgtaatattcctgtcgacatgaaaatgtttattcatgacgtgctggcgctgaatgagaatgacgatctttccattgacctgtttggtctaaaccatatggtctttattaaagatgtgctggtgaatggcacctcacggttcgcagaattactggatggcgtggcgtccggtcagttgaaagcgtcaaccgtaaaaaatatctttgatctgccgtttagtgaaggattgattcgctcgctgaacatgctgccgtgctcttatttgttgtattacttcaagcaaaaagagatgctggcgattgaaatgggcgaatattacaaaggcggcgcgcgcgctcaggtcgtacaaaaagtggagaaacaactcttcgacttgtacaaaaatcctgagctaaacgtgaagccgaaagagcttgagcaacgcggcggcgcttattattccgatgccgcttgtgaagtcattaacgctatttataatgacaagcagactgagcattatgttaatattccacatcatgggcatgtcgagaatatcccggcggactgggcggtggaaatgacctgcattctgggacgcaatggcgcgacgccgcacccgcgtatcacccgttttgacgaaaaagtgctggggcttatccacactattaaaggatttgaggtcgcggccagcaatgcggcgctgagcggaaactttaatgatgtgctgctggcgcttaacctgagtccgctggtgcattccgaccgagacgcagaagtcctggcgcgtgagctcattctggcgcatgaaaaatggctgcctaattttgccgcttgcatcgaagcgcttaaaggtaagcaccactgacagaggtaggctatggaacgcgtgttgattgtgaatgccgatgattttggcctgagtaaagggcaaaattacggcattgttgaagcatatcgcaacggcgttgtgacctccacgacggcgctggtcaatggcgaggctattgaccatgcggcgcagcttagccgcgagctgcctgcgcttggggtgggaatgcattttgttttgacgttaggcaaaccggtgtcagagatgccgggcctgacgcgagacggcctgttggggaaatggatctggcaaatggcggaggaggatacgcttccgctggatgaaattgcgcatgaactggcgtgtcagtatcagcgtttcatcgacgtatttggccgcgagccaacgcatctcgacagtcatcatcatgtgcatatgttcccgcaaattttccccatcgtcgcccgctttgcggcgcagcgcgggattgcgttacgtattgaccgccagacggtgttgaatgcagacgatctgccgtcggatttgcgcagcactcaaggatttagtagtgaattttacggcgaggagatcaccgaagcgtgctttttacgcattctggatgcctcggcgcatcgaggagaagcctctctggaggtgatgtgtcatccggcgtttgtggacaacattattcgccagagcgcctattgttacccccgcttaactgaactggaggtgttgacgtctgcgtcactcaaggcagggattgcggaacgtgtatatcgtcctggcagttttcttgatatttagctcctgagtttgcggcgcaagaatgcgccgcattttttgtctatggaaaacccccagctaggctgggggttccggaaagctttcagctttaagccagttattaaaaccccttttgatttgttaaaacatcttgcggtctggcgactgcaaaagttcaacaagaaatcaaaagggggtcccaatgggggacgaaaagagcttagcgcacacccgatggaactgtaaatatcacatagttttcgcgcccaaataccgaagacaagcgttctatggagagaagcgtagggcagtaggcagcatattaagaaaattgtgtgaatggaaaaacgtacgaattctggaagcggaatgttgtgcagatcatattcacatgcttctggagatcccgccgaagatgagtgtgtcgagtttcatgggatatctgaagggtaaaagtagtctgatgctttacgagcagtttggggatctaaaattcaaatacaggaacagggagttctggtgcagagggtactatgtcgatacggtgggtaagaatacggcgaagatacaggactacataaagcaccagcttgaagaggataaaatgggtgagcaattatcgatcccgtatccgggcagcccgtttacgggccgtaagtaacgaagtttgatgcaaatgtcagatcgtatgcgcctgttagggcgcggctggtaagagagccttacaggcgcatcagaaaaacctccggctatgccggaggatatttattttgccgtttatgcaggaatcgcgttaattttccccgcacgcgaccagacacggtgtgccgccatcagcgtcagcagagtgtccataaagtggtggtcaacgttatctgcctcaacaagtccttcttccccctggctatcaatgtttaaaagcgccttaaaccgtcgggcgtcgcctgccagtgcgatgggcttcagatgtttgtaggcttccagaaggtagtaacgggcatcgccgcaactctcgatatcggcaatattgccgcacggtactattaccgcatcgaccgttagcgacggcgcgccggcaaaggttgccgcaatagttaatgttgaaccgtcatcagccgttacttcccccatccgtgaatagagcagttttacgtggacgcctttggcttttaaagcctgaaaaatggtcaacagttcggcggcgttaaccttgtcgttcagcagaatagcgaccactcggcctttaacatcgccgtccggcaccgcatacaggctgagcgccggatcttttttcagaccgttgacatcaggaggcggggcaatttgcgtttgctcatgggtgagtgcaaaaccgagattatgcgcgacgccctgagccagcgtgacatcaatatgcgctaactgatcgaccacccgctcccgaatatacgcgcgggcgactttacccagctcaaagctgaacgcgtcaataatatgctgctgttctatcggcgtctgactgagccagaacaggcgaggatgcgagtaatattcaccgaaagaggggctgcgttcgcggatttcattaccatccacgcgttcctggtatgattcgaagccgccgcgttttggcgctggcggcgtttcgcgtggccagttgtcattaatggagtttggttcatagttcgccggattggtgtcgatatccatccggtgcataccgtcacgctggaagttatggtaggggcaggtagggcggttaatcggaatttcgtggaagtttggcccgcccagacgactgatttgcgtgtcggtataagagaacagacgcccctgtaacagcggatcgttggtaaaatcaatgccgggaacaatatgtcctggatgaaatgccgcctgttcgttttcagcgaaaaagttatccggattacggtttaacaccattttgccgacgcgttgtactggcaccaactcttccggaatcagtttggtcggatcgagcagatcaaaatcgaatttaaattcatcctcttcggcaatgagttgtaggcccagctcgtattccgggaaatcgcccgcttcgatggcctcccacagatcccggcggtgaaaatccggatcgcgaccggtcagtttttgtgactcatcccataccagcgaggctttacctgccaacggtttccagtggaaacggacaaaggtcgctttcccttgtgcattgatcagacggaaggtgtgaatgccgaacccttccatcgtccgataactccgtggaataccgcgatccgatattgcccacatgacgttgtgcagcgtctcaggctgtaaggaaacatagtcccagaaggtgtcgtgcgcgctctgcccttgcggaatagcccaatgtggttcgggcttaacggcgtgcacaaaatccggaaacttatgcgcatcctggataaaaaagatcggcgtgttattaccgacgagatcgaaaattccctcttcggtataaaatttggtcgcaaaaccgcggatatcacgtacggtatcagcagaccccgcgccgccctgtactgtcgaaaagcgaacaaagaccggggtaattttctgtggatcgcacagaaacgcggctttcgtgatgtcgctcaggtctttatatggctggaaatagccgtgcgctgcagatccgcgggcgtgaacgatcctctccgggatacgctcatggtcaaagtgggtaattttctcgcgcaggataaaatcttccaacagcgtagggccacggctgccggcgcgaagagaattttgatcgtcggcgatgcgcacgccctgattggtggtcagcgcataattttcgctgcctttacgaaaggcgtcgagggcggtgagcttatcattcgcggtctcgggcgcttttaagctgccgggggccgttggttgcgcgcccggcggcgtcggttctggcgtggggcgatgtgaaccgtctgacggtgccagggagtccaggccgggctgtgattcacgggtatcatgcacgggggactgatggggggatttttcattatgcgacattgaactcgtctcctgctttcatcactgaaatgggcgtggtagtagtcaaaatcactctaactatagaacatttcagcaattatgccgggggagagcggaacggcagacagggtacaacggggaaatcgcacgcgcggaacaggacgtcgggggcgaagatcggctaaaatagtgtttttctgatttttagccttagcctcttttagtgaagcattaatgatgaaacctcttcgccagcaaaatcgccagattattagctatattccgcgtgttgaacccgcgccgccggaacatgcgataaaaatggatacgtttcgcgacgtctggatactgcgcggtaaatatgttgcctttgttctgacgggggagtcatttcaacggtcgcccgcctttagcgtgccagaatcggcgcaacgttgggcgaatcaggttcgccaggaaaacgaaatcgctgactaagaaaaaaacaaaacgccggtactggagaccggcgtttttagtgacagacattttgagttgccgatcgtcgtgtctcagacgatgtgaactcccgataatgtattatcgatgcgccagttcagcgtcttcttcgctatcgagaatggttttatcggtctgcttcagccactggctggtcagcgtacccgcggtcattgagccgctcacgttcagtgcggtacggcccatatcaatcaacggttcgacggagattaacagcgcgaccagcgtgaccggtaagcccatggcaggcagcacaatcagcgcggcgaaggtcgcgccgccgccaacgccggcaacacccgccgaacttacggtaacgatacccaccagcgtggctatccatacggggtctaaggggttgatgccgaccgtcggcgcaaccattaccgctaacatcgcaggataaagaccggcacaaccgttttggccgatggtcgcgccaaaagaggcagcaaagctggcgatggactccggcacgcccagacggcgggtttgcgcttcgacattaagtggaatggaggcggcgctggagcggctggtaaaggcaaatgtcagcaccggccacaccttgcggaaatatttcagcgggctaatcccgttcacgcccaatagtatgccgtgaaccacaaacattatcgccagaccaagatatgacgctaccacgaagcttccaagcttaatgatgtcctgcaaattagagccggcaaccactttcgtcatcagcgccagtacgccgtaaggcgtaagttgcatcaccagacgcaccagcttcatcacccagctttgcagggtatcgatagcaacaagcacacgctcgccttttggcgcatcatctttcagcagtttaagcgcggccacgcccaggaatgcggcgaaaatcaccacgctgataatagacgtaggatttgcgccagtcagatccgcaaacggatttttcggtacaaaagacagcaccagttgcggcacgctgagatcggccactttgccgacatagctcgtctcaatggcattcagacgcgcggtttccgcgccgccctgaaccagaccttccgccgtcagtccgaacagattggtgaccagcacgcccaccagcgctgcgataaaggtagtaaacagcagcgtgccgatagtcagaaaactgattttccccaattgagaggcgttatgcagtcgtgccacggcgcttaaaatagaggcgaataccagcggcatcacaatcatttgtagcaattgcacataaccgttgccgacaatattgaaccactgaatggagtcttttaacacctgactgtcagcgccataaatggtgtgcagggccagaccaaagaccacgcccatcacaaggccgacaagcacttttttagccagactccactgtttatgacgggcctgcgccagtacaaacagcagaatgacgaacaccgcaatgttcgcaattaatggaaaattcatccccgttctcctgatttttttattatgaagcgctgtgttttagcgattctgttcgcgcaagattagcagaactgtgagctggctcttatattcaaatggaatggtttatacctaaaatgactttggcgttgatttactaatcaatctggtgatttataaaacgattgaactgcatttgcaggatagtgatcatctgcgaagaccagcgtatgacgttgttttccggcatggattgcggcatccacaccgcccaggcaaacaacgccatacataaaaatcgctccagttgattgcccttgcgcggcgccagaataggcaggcggaaacgccagcgacacggccacagtaagggaacgcctgcgggggtaagcatatccgcgacgatatggcttaaatagccgagtaccatgccttgcagcgcatccgccgggataatccacgtatccggaaccttgagataaaaggtcgccagtagggcaaagaccgccagcagactatgggtaaacccccggtgaccgaatgcgcgggcgatcggtttcgatacccatttcaggcgctgaccaagaaaagatttggggtgatcgatatccggcagcagacaggtcaaaatagccgaaggaataatatgccaccagtcgccgtgcgcaagggcgggcgttaactcggcattcttggcgaaaaccgcgctggctatagaaaaaagaagatgtccttccgccgtcatgataaaacccattaaactgtcaattcatacagtatagggtttttatacagtaggcggaagtggtgacgttgtaactctttgtctctgtcaaagccgcttgccgtctggctcagcggctaattgcccgttgactttgtttcggaaacatcttaaccgagtagatgcgccgccgtcagctctgtcagtgagttaagtttgacattcgccagcgcaaagcgcggatcatgctggttttcttctgctggcaccacaatggcgcgcattcgcgccgcctttgccgcgattaaaccattcaccgaatcctccagcgccacgcaggttaatggatcaacgcctaatttggccgcacaatccagatagacctgcgggtgcggtttgctgtagggcaatttttccgcagaggccagcgcgtcaaaactgtcgcgcagttcaaacatggtgagcactttttccagcatatgcagcggcgatgccgaggcaagccccactaatagcccctgcgctttacacagcgccacagcttcgcgcacacccggcaaaagagggcgcgtctcttcgataagcgtaatcgcgcgggcaataacacggtttgtcacttcctggcgatcggggccgttccacggttgctgcgcaaaccagagatcgacaaccatatcaatgcgtagcctaagcgtgtctggcagttcatggcgccgagtaatatctacgcctaaacttgccatcacgtccagttcagcgcgatcccagagcggttcggaatcgatcaatagtccatccatatcgaaaattgcagcaagaatttgacgtggggttgacatcacaacctctcctgttgagattaaaaaataacgaattaagcgttcattatgaccatgttcttagtatatcgcccttaaagatcaggcgaaaacgggaatcaacaggtagacttaggccaaaacgacgcgtctttatcaaggggaactcatgacgtatcaacaagctggacgcattgcaatcctaaaaagagttgttgggtgggttatttttattccggcactgctttccacgctcatctcagtccttaaatttatgtatgcgcacagtgaaaagcaggaggggataaatgcggtaatgctggattttacccacgtaatgatagacatgatgcgcgtgaatacgccgtttctgaatgttttttggtacaactcgccgacgccgaattttcagggaagcctgaatatcggtttctggctcatttttattctgatttttgtcgggctggcgatgcaggattccggcgccagaatgagccgccagtcacgttttttacgtgaaggcgtggaagatcagttgatcctggaaaaagcaaaaggcgcggaaggactaacgcgtgagcagatagagtcacgtatcgtggtgccgcaccataccatctttttacagtttttcccgctctatattttgccggtcattattatcgtgctcggctactttttcttttccttgttaggtttcatgtaaactgaaaaatgccggatagcccgtatccggtgtgggctgtacctataccgcaagcagccgatccatcgctttttgcgcagtagccaggtgctgaccgccaaacagccttgcccgattaagcagggtgtagagctggtaaatcggctgcctgtcgagaaaatccagcggtagcggcgaaacggactgatagccgtcataaatctgcggtggctgatcggtatgcagcggcagcatcgccagatcgcattctctgtcgccccaatagcaggctggatcgaagatataggggccgtcagggccaagcgcgcagttcgccgaccatagatcgccatgcaaaagagaaggctgcggttgatgcgacgccagacgttgctgaacatgttcaacaatggcgtcaatattaccaaaggtaatgcctttttccgcggcgagttcaagctgccagccaatgcgctgttcggcgaaaaaagtcgaccaacggcgttgccaggtattcggctgcggcgtggtagagagcgcgttatcaaaatcgaggccgaattgaggttggtcgctccattggtgcaggcgcgccagctgttgcccaagaataaacgcattatgggcatccagcgggcggggcgagaggtagtccatgactaaaaagctgtaatcccgatccgaacctaccgcccataccttaggcacaacaacggttttactgcgggagagcagctccagctgatcggcttcagcggtaaaaccgcgaagcatttctcgttcatcgcacttcacgaaaaaatcatggccggcataacgtaaatgccatgcggcatgaacttctccgcctggcagttcattacgcagttcgatttcgccttcaccgacttgctcgcttaaaagacgactgatagcttgccacataatgtctctccccacgttgtctgccagatcataaggttagcgcaaaaatgcggttaaaaaatacgaactaacgcacatcgcggacgcgccgcggcgggaatggcacttattgtgcgtttttactccacgcctcccaggtcgccacggtaatgtcgacatccttatctaacgcgcttttcgcaagtccggcgacaagcgctttgatttcatcagcgctctgagcgctaacaaagccaaacgtattggtgccgagctcatgcacattcccttcatcgtccgttaatgtcagcaaaaaaccgctgcgcgtcagatggttattgagttcgttaatctcggtcagggaatcttcatggaaggttacggtaataacataacgggtaatatcgccactggccatcgttcacctcgttgggagcaactgtgtttttaacagcggcggatgcgccgcccgttaaccgattttccggtatccccctcggcgagggggaaacgattattgcgcggaaagataggcgtatattttttgggtatcgtcatgagaacacagacgcgtaccttgattgagcgtagcggcgctgcctgccgccacaccgaagcgcaccatctcttccagcgacgcgtcttgcgccagttttaacgtcatcgcgcccaccatactgtcgcctgcgccgacagtactttgacttttcaccgggggaggaacaacctggatgcaattctcactgtctatgcccagcgccccttgcggccccagagagaccactacccggcgagccttgccactttgcactaattcctgggccgctttacgcacatcatcaggctgcgtcagatcgcgattgactaacgcgctcaattctttcaggttaggtttcaccagttcgatatcgccaagcgccaacgcagcggtgagcgcgtcgccagagctatcaataatgcagcgaatgccttgcttctgcgcggcggaaatcagttgcgtgagtttctcgaccttaacgccgggcggaaggctgccgctgataaccagaattgccccggattcaatttccagtacctgttcttcaagctggcgaaattcgtcatcgtccagcgtggcgccgggcataacaaaacgatattgttcgccgctggactcgacgtggacgtgcaggttctgacgcgtccagtccttcgcatcgacggtagacacggggacattttcgtcagccagtagtgcgaccagatgttcgccggtagcgccgccagccgggaaaattgcggtcgcggtgccgccaagatgcgcaatggcgcgagcgacattaatacccccgccgccgggttcgaataccggcgcggagcaccgcagtttaccttcgggataaatttgcggcgtgattgttgcgctatcgagagagggcgcaagcgtcaacgtatagatacgtaccatcgttacctcctgttaggctgatttcagtctggcacttaatccccggaaagtgaaggaattaacaatatgattttccggatctttatttaaagaagtacgatgtaaagttatataaataaatgaatgcttcgggagggttcttattcaaaaaatgaaatagtaattgattgctatgttattcggggcttcttataattcgctacctttccaggggcgtttgtcattgatccctatgaaagtttccgggaccgtcgtggtctcttttttagttgtacggactctatataaatgaagcttttgaaggcagtacccgctgtagttatgctggcgggtggcgtgttcgcgtctctgtatgccgccgccgatgattccgtttttactgtcatggatgatccctccaccgcgaaaaaaccttttgaaggtaatctgaatgcgggctaccttgctcagtcaggcaatactaaaagttcttccttaacggctgacacggcgatgacctggtatggacaacgtaccgcctggtcattatggggcaatgccagcaatacctcctctaatgatgaacgctcttcagaaaaatatgcggtaggcgtgcgtaaccgttttaatatgacggattatgattatacctttggccaggccagttggctgacagaccgtttcaacggttatcgtcagcgcgacgtactgaccgccggttacgggcggcagttccttaatggtccagtgcacagcttccgttttgaattcggtccaggggttcgctatgacgaacatacggacgataccactgaaacgcagccgttgggttatgcttccggcagctatgcctggcagttaactgacaatgctaagtttacacagggggtgtcagtatttggcgcagaagacaccacactaaattcggaaacagccctcaatgtcgccattaacgaacattttggtctaaaggtggggtataatttaacgtggaactcgcagccgcctgaatcagcgcctgaacataccgatcgccgcactacggtaacgctgggctataagatgtaatattgcgccgggttacgttacgtaacccggttattccgtggtgacgcctcagaagaagaaggtgatgtcgccgttgatataagaatagtcgtctccggtgcgaaattccgacgtgactttgtttaaagaaagagaaaatgcgacgggagaatagccgatggtggcaccgacgcgatattcatccacggttttattaatatccaccgtttccatttttgtttgcagcgttttcccctgtaacgtgtagtttttatcaacttccctgcgctcaacgccagcaaatactttatagatcaatccctctttttgagtgtgtattaaccctcggcgggacaataacccaaacccattatcagagttgaaggtcttatcatttcccagcgcaacggttgcgccgtaccccaaatactggaagagattgccgccgacagcagagacttctggatagaagcccacattgacacccagaatatcaatagctggcgtaagggagaccattccttttgccgtgtaaccataacggttttcaatttgatcctgccaggcagggtatttttctgcgcctattattcgatgcgcccgattctgaacctcctgaccgcctgcgtcaggaccaataacgccgatatcggtacctaaacgataacgtaaccaattggtggctaatgaattccactccagtccggtatgaagaaaggcgctgaacgcgcggtcgcctttgacggcttcaggctttcttttattggcgccagatggagaataaatatcttgcgcgatatgaaaagagagttgactggcgtcagtgagatcgtggctgtagcctaaaaagagcccggcagtataatcaccccggtctgcagccttgtgcccgtaaagggcatttaaggatggttgaaatatacctgcatcatcattcgccactgaaatagcaaggctactggcattggccattgtggtcgtactgagtatggcggcaatcatcgttgcgcaatagctgtatttgttcactttttacccctgaatatgaaagtgaatactcttatttttacaaagtaataagcacagcagcatgatgcgcagtgcttattaaacctttaaatataactaaactcctgccagcagcgagtcattgagaggatacgttgccttaatgttgaaaaatggtgttaaaaaacatgcgccagatattattgaatatccatttttcattcgctatctgagtgcgagaaattattggcttcacgattatgcatataatacgatgttttttggtatcaacatgaatatcatgttgtattcttttgagctcattttctttgatggcttcgatgtttatctgttattaatttttaccgtgatagtgttgtctttaatgatgagcgcatctaacggctggcagggtaatataaccaaattattgccatctgaattattagggcagttattattaaggaagaaaaaatgaataaaaccattaatctgctaaaattactgcccgtagtattattaagcgcatgtactacatcgtatcctccccaggatacaacatcggcacccgagttaccccatcgtaacgtactcgttcagcaacctgataactgtagcgttggctgtcctcaaggaggaagtcaacaaacaatctatcgccatgtctatacgctcaataataatagcgccacgaaatttgccaactgggttgcctatagcgtgacaaagaccagccaggcaagcggtcgcccgcggaactgggcgcaggaccccgatttaccgccctcggatacgttggccccttcggcctataaaaatgcccatacgctattaaaagtcgacaggggacaccaggcgccgttggcaggattgggcggcgtttcggactggccgtcgttaaattatttatcgaatattacgccgcagaaatccgccctgaaccagggagcatgggctgcactggaaaaccgggtgcgcgaacttgccaaacaggctgatgtatctgtagtgcacgtagtgaccggcccccctttttgagcggcatatcgccacattgccagaagatgcgacggtagaaattcccagcgggtactagaaggttttattcaccggaacggcgccgtcaaaaagtgaaggaaattacgctgcgtttattatggatcagaatacaccccgttcggcgaatttttgcgactatcaggttaccgtggaggctatcgaacataaaacgaagccagtgctgacgctgtggtctaacttgcctgaagcggtagccagcgaggtgaaaacaacaaaggggagtctggcgcagaggttaggttgccgatgagaagcgctatacggcgcgtagaaagataatggagaaaccctgtcaaggggcttgatttgctacagagtgatgcaatccccctttttttagtgttaccatcatcatgccggacgaaaatagcgattttcgtctgtgtcgaaggttgtgcgccaatttagcaatggttggctagatggatacacaactcactgttaataaattcattttctctttgtatgtgatcttgcgtaataagtacaatcctttattcacatccattctcgttcgtttaaacctgtttcaccagttccgcgtcattactggtaatagcggatatatatgtttcataccgttttacattgatccctttcgcgccgtaagatgtacgtacctaatctaacttaagcagggaactgtcattcataacacagagtttattggtatcaatggtagattatattacggtgacaatctcgggatgatccgcatatgagtagatgtggattagggcggagtagcggcaggactaataataaccggcggcgagaaatacataattgaggggctattcataaatcatcatctagaaacgcaagcactatcatgaatatatcataagtaatttacgttggtaatgatggctcagcaaacccaacaagctttacaggaacaatttttacgcttcagagccaaataaaacggcggcattgccgccgtataacttatttattgtttcttagtaaaacgaatcttatatgctctgaaaaaacaaaggaagatgcaatgtataccataaaagcaatcatcaaatgctcagggaacaaccatcccatgctaacaggaatcacacttattccaatgcaaaataggaacattatgaaataatgcgctgactttgtttcctgagttttattggagaaatacttagctaggacgcctttaaatactccagatataactaaccaaactggtgtaaaaagcccgaaatctgcgtatagttcaccatacccgaaagcaggagcgccctgatttctgtagaatgcatcagggaaaaatacttttgccagatacaatgcgccaaaatcttcaggcttatcaggccaaatagccctcggaatcctcgagtaaacctcgctctccattagtaattttccgtacataaagtcaaagtttgaggaagcaacaagaacagcattacgggtataatccgagtaattagccatattttctatcggattcccatcagtaaacgtatatgcaaagaatgccgttacaatgactgctataacagcaaacgattttaccaggaacataaatttaatttttttattttcaatatatgaaaggtaaaggatgaatgctataaatatactaaatattggtcctttgttaccatgcaagaaaataagtatacagttaaataaaactatggaaatacaaaataactttgattttttgtatgtaaagaacgcgcaaatagaagcgacaagagaaaacattaatgaaggatagaagtatataccataccctgttctggttaattcgtatattcttcttgggctaagtatatactctctgaactccatcaacactggaaggtaaatgataaaagcaaggaaggtgaataacaatgaagtaaacacataccttggtttatttttcgtgtttgatttgttgtatatgggttttctttgtgtgtaaagataagaaataacaaatgatgctatgtatgttatatagcaagtatagaaaaacaaatattccactgtataattctgcacctctgagaggtatacaaatataccttcaaacacgtacagtgtagggactgttattatcaggtatgggaccattacatttattatttttccctcaattcttacggaaagagtatagagataaactataaataataagcataatgcaatgtatgaaattataagcatatagagcctttagaaaaaatgcttagtattaaaaatattaccatcaggcaaataaggtgtggtacggaaaatcttctggcaagatattctgaatctggtagtctataatcattactcatcactatcttcccgatatcaaaaccgtgttattgaaatattaacactcattaacactcctatctactgcgcctccgatagcatgaagctatcaagcgtttgcagcacaaacatcaaacaatgtaaatgcttttgataattacgcatgattgttactgtgtttatatacagtggcattcgaagattcatcatgaggttcccgagtcctgtaaaagactatacagagaaagagctatcactcgacgagtaattcatctcacatcgtgccgcgacatacttcaagcaacacagacgaattacaagtacggcatcataagtgagacgttgctagttatagaagcttcatagcagcatgtaatggctctttgctggtatgtgctttggaaagtgggtttcgtattgtgcgttatcgcatgctgccaggtccccatctggagaatatagatagcggtcgtcgtgaaaagctatctgatgtgaatgcctcatacggtggcagtaagccgagattcagagtgaccatgtacatcattaacgatacgcgtgccgggtagtgtgttgggattcaggttctgtagaacagaaagatgcaatctccctttttttagtgttaccatcatcatgccggacgaaaatagcgattttcgtctgtgtcgaaggttgtgcgccaatttagcaatggttggctagatggatacacaactcactgtcaataaattcattttctctttgtatgtgatcttgcgtatgggtcaccactgcaaataaggatattacatgcctgttattactcttcctgatggcagccaacgccattatgaccaccctgtaagcccgatggatgttgctctggacattggtcctggcctggcgaaagccaccattgcgggccgtgtgaatggcgagctggttgatgcttccgatctgattgaaaatgatgcgacgctttccatcatcaccgcaaaagatgaagagggtctggagatcattcgtcactcttgcgcgcatctgttaggtcacgctatcaagcaactttggccgcacacgaaaatggcgatcggtccggttgtcgacaacggtttttactatgacgttgatcttgaccgcacgctaactcaggaagatgtcgaagcgctcgaaaagcggatgcatgagctcgccgagaaaaattacgacgttatcaagaagaaagtcagctggcacgaagcgcgtgaaaccttcgtgaagcgtggtgaaagctacaaagtttccattcttgatgaaaacattgctcatgatgacaagccaggcttgtaccatcatgaagaatatgtcgacatgtgtcgtggtccgcacgtgccgaatatgcgtttctgccatcactttaaactgatgaaaactgccggcgcatactggcgcggtgacagcaataataagatgttgcagcgtatttacggtacggcatgggcagataaaaaagccctgaacgcttatctgcagcgcctggaagaggccgcaaaacgcgaccaccgtaaaattggtaagcagctcgacctgtatcatatgcaggaagaagcgccgggcatggtgttctggcataacgacggctggactatcttccgcgagctggaggtctttgttcgttctaaactcaaagagtaccagtatcaagaagttaaaggcccgttcatgatggaccgtgtgctgtgggaaaaaaccgggcactgggacaactataaagatgcgatgttcaccacatcttcagaaaaccgcgaatattgcatcaagccgatgaactgcccgggccacgttcagatctttaaccagggtctgaaatcctatcgtgatttgccgctgcgtatggcggaattcggtagctgccaccgtaacgagccatcaggcgcgctgcatggtctgatgcgcgtacgcggctttacgcaggatgatgcgcatatcttctgcaccgaagagcagatccgcgatgaagttaacgcttgtattcgtatggtctacgatatgtacagcacctttggcttcgagaagatcgtcgtcaaactttccactcgtcctgataagcgtatcggcagcgatgagatgtgggatcgtgctgaggcggatctggcggttgcgctggaagaaaataatatcccgtttgagtatcaactgggtgaaggcgcattctacggtccgaaaattgaatttaccttatatgactgcctcgatcgtgcatggcagtgcggtacagtacagctggacttctccttaccgtctcgtctgagcgcctcctatgtaggcgaagacaacgagcgcaaggtgccggtaatgattcaccgtgcgattcttgggtcgatggaacgcttcatcggtatcctgaccgaagagttcgctggtttcttcccgacatggctcgcgcctgttcaggtagtcgtgatgaatattaccgattcgcagtctgaatacgttaacgaattgacgcagaaactacaaaatgcgggcattcgtgtaaaagcagacttgagaaatgagaagattggctttaaaatccgcgagcacactttacgtcgtgtcccttatatgttggtctgtggtgataaagaggtggaagcaggcaaagttgccgttcgcacccgccgcggtaaagacctgggcagtctggacgtaaatgacgtgattgagaagctgcaacaagagattcgcagccgcagtcttcaacaactggaggaataaagtattaaaggcggaaaacgagttcaaacggcgcgtccgaatcgtattaatagcgaaattcgcgcgcaagaagttcgcttaacaggtctggaaggcgagcagcttggtattgtgagtctgagagaagctctggaaaaagctgaagaagccggagtagacttagtcgaaatcagccctaacgccgagccgccggtttgtcgtataatggattacggcaaattcctctatgaaaagagtaagtcttctaaggaacagaagaaaaagcaaaaagttatccaggtgaaggaaattaaattccgtcctgggacagatgaaggcgactatcaggtaaaactccgcagcctgattcgctttctcgaagagggcgataaggccaagatcacgctgcgtttccgcggtcgtgaaatggcccaccagcaaatcggtatggaagtgcttaatcgcgtgaaaaacgatttgcaagaactggcagtggtcgaatccttcccaacgaagatcgaaggccgtcagatgatcatggtgcttgctcctaagaagaaacagtaaggccttcaagtaacaattctgtgaagccttcgggcttcacaggttttgttcgcctatgtttcgtttattaacaatgcgaagtggaagttattaaaatgccaaaaattaagaccgtacgcggtgctgctaagcgcttcaaaaaaaccggtaaaggtggttttaagcacaagcacgctaacctgcgtcacattctgaccaaaaaagcgactaaacgtaaacgtcacctgcgtccgaaagccatggtttctaaaggcgatctgggcttggttatcgcgtgcctgccgtacgcataagccgttaacgtttttaactttttaattagaatagatacaggagagcacatatggctcgcgtaaaacgtggtgtaattgcacgcgcacgtcacaagaaaattttgaaacaagccaaaggctactacggtgcgcgttctcgcgtataccgcgttgccttccaggcagttatcaaagctggtcagtatgcttaccgtgaccgtcgtcaacgtaagcgtcagttccgtcaactgtggattgcgcgtatcaacgcagcagcacgtcagaacggtatttcttacagcaaattcatcaacggcctgaaaaaagcctctgttgaaatcgaccgtaagatcctggctgatatcgccgtattcgacaaagtcgcgttcaccgcgctggttgaaaaagcgaaagcagctctggcataagccagtgaaaagagggagcctggctccctctcttttatttactgttcagtgagttgacaattgacctgtaacccttttcaataaaggatattcggttttaccacataaggtaacgcaagcatgaacgctgctattttccgtttctttttttactttagcacctgatcccaggaggctagcgcgtgaaaaacgaaacgaaaaacagcgtaaaaaagcctcctgatggaggctttttttgtatctgaaatcgagagattacgtccaatgaaccggtgtcttcaccgacacaatgaggaaaaccatgtcacatctcgcagagctggttgccaatgcagcggccgccattaaccaggcgtcagatgttgccgcgttagacaatgtacgcgtcgaatatttgggcaagaaagggcatttaacccttcagatgacgaccctacgcgatctgccgccggaagagcgtccggcagccggggcagtcattaacgccgcgaaagagcaggtacaacaggcgcttaacgcgcgtaaagccgagctggaaagcgcagcgcttaacgctcgtctggccgctgaaactatcgatatctccctgccgggacgccgtattgagaacggcggtctgcatccggtcacgcgtaccattgaccgtattgaaagtttcttcggcgagcttggttttaccgtggcgactggcccggaaatcgaagatgactaccataacttcgatgcgttaaacattccgggtcatcacccggcccgcgccgatcatgataccttctggtttgacgcgacccgtctgctgcggacccagacgtctggtgtccagatccggacgatgaaagcgcagcaaccgccgatccgtattattgcgccgggccgtgtataccgtaatgactacgaccagacgcatactccgatgttccatcagatggaaggtctgattgttgataccaacatcagcttcaccaacctcaaaggtacgctgcacgacttcctgcgtaatttctttgaggaggatctgcagattcgcttccgtccttcttattttccgttcaccgaaccttctgcggaagtggatgtgatgggtaaaaacggcaaatggctggaagtgctgggctgcgggatggtgcatccgaatgtgctgcgtaatgtcggtatcgatccggaaatctattctggcttcgcttttggtatggggatggaacgtctgaccatgttgcgttacggcgtcaccgacctgcgttcattcttcgaaaacgatctgcgtttccttaaacagtttaaataaaggcaggataaaacaatgaaattcagcgaactgtggttacgcgagtgggttaacccggcaattgatagcgatgcgttggctaaccagattacgatggctggcctggaagtagacggcgttgagccggtcgcgggaagcttcaatggcgttgtggttggggaagtggttgagtgcgcccagcatccgaacgctgacaaattgcgtgtaacgaaagtcaacgtcggcggagaacgcctgttggatatcgtctgcggcgcgccaaactgtcgtcaggggctgaaagtagcggtggccactattggcgctattctgccgggcgatttcaaaattaaagcggcgaaactgcgcggcgaaccgtctgaagggatgctgtgctccttctccgaactggggatttccgacgatcacagcggcattatcgaactgccggcggatgcgccgttgggtaccgacatccgtgaatacctgaagcttgacgacaataccatcgaaattagcgtcacgccgaaccgtgcggattgcttaggtatcatcggcgttgcgcgtgatgtggcggtactgaacaaagcgccgctccaggagcctgaaatggcgccggttacggcaaccatcagcgatacgctgctgattacggtagaggctgttgatgcgtgtcctcgctatcttggccgggtggtaaaaggtatcaatgttaacgcgccgacgccgctgtggatgaaagagaaactgcgtcgctgcggtattcgctccatcgatgcggtggttgacgtcacgaactatgtgctgctcgaactgggtcagccaatgcatgctttcgataaagatcgcattgatggcggtattgtcgtgcggatggcaaaagagggtgaaaccgtcgtcctgctggacggtagcgaagcgacgttaaatgcggacacgctggtgatcgccgatcaccataaggcgctggggatagccggtatttttggcggcgaacattccggcgtgaacggcgaaacgcaaaatgtgctgctggagtgtgcgtactttaatccgctgtctatcaccggtcgcgctcgccgccacggtctgcataccgatgcgtctcaccgctacgagcgcggggtggacccggcgctgcaatataaaacgatagagcgcgctactcgtctgcttcttgatatctgtggcggtgatgcgggtccgataattgatgtgagcaacgaagcaacgttgccgaaacgcgccaccattactctgcgtcgcagtaaactggatcgcctgatcgggcatcatattgcggatgagcaggtcagtgatattctgcgtcgtctgggctgtgaagtgaccgaagggcaggacgagtggaaagccgtggcgccgacctggcgtttcgatatggagattgaagaagatctggtggaagaggtggcccgcgtttacggctataacaatattccggacgagccaatccaggccggtttaatcatgggaacgcaccgtgaagccgatctgtcgttgaagcgggttaaaaccatgctgaacgacaaaggctatcaggaagtgattacctatagctttgtcgatcctaaagtacaacagctcatccatccaggcgcagaagcgctgctgctgccaaaccctatctccgttgagatgtcggcgatgcgtctgtctctgtggagcggattgttggcgacggtggtctataaccaaaaccgtcagcagaatcgcgtgcgtatttttgaaaccggtttacgtttcgttccggatacacaagccaatctgggtattcgacaggatctgatgctggctggcgtgatttgcggtaaccgctatgatgagcactggaacctggcaaaagagaccgttgatttctatgatttgaaaggcgatctggaagcagtattggatttaaccggcaaactgggtgatatccagtttaaggcggagatgaatccggctctgcatccgggacagtctgcggcgatttatctgaaagatgaacgtattggttttattggggttgttcaccctgaactggaacgtaaactggatctgaatggtcgtacgctggtgtttgaactggaatggaataagctcgcagaccgtatcgtgccgcaggcgcgggagatttcacgcttcccggccaaccgtcgcgatattgcggttgttgttgcagaaaacgttcccgcagcggatattttatccgaatgtaagaaagttggcgtaaatcaggtagttggcgtaaacttatttgacgtgtaccgcggtaagggtgttgcggagggttataaaagcctcgctatcagcctgatccttcaggataccaaccgtacactcgaagaagaggagattgccgctaccgtcgccaaatgtgtagaggcattaaaagagcgattccaggcatcattgagggattgaacctatggcgcttacaaaagctgaaatgtcagaatatctgtttgataagcttgggcttagcaagcgggatgccaaagaactggttgaactgtttttcgaagagatccgtcgtgctctggaaaacggtgagcaggtgaaactctctggttttggtaacttcgatctgcgtgataaaaatcaacgtccggggcgtaacccgaaaacgggtgaagatattcctattacagcacggcgcgtggtgaccttcagacccgggcagaagttaaagagccgggtcgaaaacgcttcgcccaaagaagagtaatcagatccaggcataacatccatcagggtgtattgcggcagatacgctgccatcccgaaagtagatcagcgggatgacagcgtatttgtcagcctgaaagatgacccgtataactaaaaaggccgcattgcggccttttttctttcaagtaaaggatacccaccgtaaaatcacgctacctcttttcagctgaatggataacatgctgacttttgcccgccaacaacagcgacgaaacgttcgctggcttctgagcctgtcactgctggtgctactggctacacttctgagcttatgcgcaggcgaacagtggattgcccccggtgactggttaagcgcccggggggaactgtttgtctggcaaattcgccttccccgcacgcttgcggtattgctggttggcgctgcgctggcgctatctggcgccgtgatgcaggcgctgtttgaaaacccacttgctgaaccgggtctgctcggcgtttcgaatggggccggtgttgggcttattgccgccgtcttactggggcaggggcaactgccaggatgggcgctggggctgtgcgctatagccggcgcgctcattattacgttaatcctgctgcgttttgcgcgtcgccatctctctaccagccgcttgttgttggcgggcgtcgcgctgggcattatctgtagcgcgctgatgacgtgggctatctatttttccacctctttcgatctgcggcaattaatgtactggatgatgggaggatttggcggcgttgactggcagcagagctggctaatgattgcgctcatcccggtactgatctggatatgttgccagtcgcaaccgctgaatatgctggcgctaggggaaacctcggcgcggcagcttggcctgccgctgtggctctggcgcaatttgttggtcatcgccaccggctggatggtgggcgtcagcgtagcgatggcgggggcgattggttttatcggtctggttattccgcacatcctgcgcttatgtggtttaaccgatcaccgggttttacttcccggctgcgcgctggccggggctatcgccctgctattggctgatgtggtcgcccgactggcgctggcgtcggctgaactgcctatcggggtggtcaccgccacattgggggcaccagtgtttatctggctgctactcaaatccgcgcgttagcgcatcggtaaacaactgctttcatcattcgcagtctatgattaaaggctaacgatgaaacccgctattctaccgacatcagggagacaccatgcaaaactcgcttcttaatactcacgttacgacgattgatggagaggtcactacacttgaaaaatacgccggaaaagtgctgctcattgtaaacgtcgcctccagatgtggcctgacgccgcaatatgaacagttggaaaatatccagaaggcgtgggcagatcaggggtttgtcgtgttgggttttccctgcaaccagtttatggggcaggagccaggcagcgaagaggagattaaaacctattgtgccagcacctggggcgtcacgttcccgatgttcagtaaaattgatgtgaatggcgacgcgcgccatccgctgtatcaaaaactgatagccgctgcgccaacggcagtcgcgccggagaagagcggcttttacgaacggatggtaagcaaagggcgtacgccactctatccggatgatattctgtggaattttgaaaaatttttggtaggccgggatggtcaggtggtacagcgtttttcgccggatatgacgcctgaagatcctattgtgatggaaagcataaaaatcgcgttggcaaaataatgtctcaattgatgcaattaaaggacgtcgccgagagcacccgcctggggccgctttccggcgaagtaagcgcaggagagatccttcatcttgtcgggccgaacggcgccgggaaaagcacgctactggcgcgtatggcggggttaacctccggcgaggggagcatcaggtttggcggagcgccgctggaggcatgggcgacggcaacgcttgcccaacaccgcgcttatcttgcgcaacagcaaaatccgccgttcgccatgccggtctggcattacctgacattgcatcaacctgataaaacgcgaaccgggcagcttaacgaggtggccgatatgcttggattgggcgacaaactggggcgaagcgtgaatcagctttccggtggcgagtggcagcgcgttcgccttgctgccgttgtactacaaattcatcccgacgctaatccggtcggtcaattattgctgcttgatgagccgatgaacagtctcgatgttgcgcaacaaaacgctctggatcgggtattacatcatttatgtcaggcaggaattgcgattgtgatgagtagccacgatctgaaccacacgctgcgccatgcgcataaagcctggttactaaagcgcggtaaactcattgcctgcggccgccgggaagaggtgctcaccccctcttatctggcgcaagcctacggtttgcgctttcgacgactcgacgtcgaggggcatccaatgctcatttcggccacttaagtaaaatcgtttcttgaaaagcaggtaatttcgacgctaaattaataccaaaataaaaacagaggattgttgcggcatgcgtttttggcttcttgttatcacagcattgttcctggcaggatgcagtactcatcgggcaccggcgccaaatgccagattatcagactccattaccgtcattgcgggtctgaacgatcagttgcagtcctggcgcggtacgccataccgctacggcagcatgagtcgcagaggcgtggactgttccggctttgtggtagtcactatgcgcgacaagtttgatttgcagttgcctcgtgatacgcgtgaacaatcaaaaatcggcaccagaatcgataaagatgaattgctgcccggagatttggttttctttaaaaccggttcgggcgaaagtggtttacatgttggtatttacgatacaaataatgagtttattcatgcctctaccagtcgtggcgtgatgcgttcatcgctggataatgtgtactggcgaaaaaacttctggcaggcacggcgaatttaacctcgcagacgatataaattttatagtctatttttaacatatcgccagttgaacttatgacatctgttgtcatcatatataatgatataaccgtagcatttacaaacgtacttttattaaaaacgggcgtgctcacgccctgttaaaagtacaacattggatattggtttataatcagagtaagttaaaaaaaggaaccggttcaccggtaaacaagaaaaatgatgacgcttcaattagtatctgaagttacgtctgtttccgtccgtagtgactggatggtgaatagcgccctaaccatgggactggcgtaatgattgcttcacttgatgagctttaccattccgaactctttttccttcccgtcatggatgaaaacgctcggcttgttggtttagagattattgcaacgtttgccgctgaagacggcgccgtgcggatgccgactgagttggtagcgcctcgcctttcggtggaggaacaatactgtctgtttgttgaaaaactggcgttgttagaaacctgtcagcacttttttattcagcataaacttattgcatggcttaatttaccgcctgcaattagtgacttattattattagatagcgaacttttttcccgggcagcgcgctttccgttttttgaagtagctataaatgagaattatcctgggttaaaccagggcaaaaacaatgaaacgttagctaatctggcaatgcatttcccattaattttggcaaattttggggcaggcgaggcgtcgactaaagctattttcgatgggcttttcaaacgagtcatgttggataaaaattttattcagcagcgagctgaaatgatctcattcgaaccattcatgcacgctattgttgcccagatctcctccagctgcgagtcgctgatgattgccggtattgatactgaggcgatgtttgcgcgcgcagcgccattggggtttagcgcattccagggcggactatggcctccggtgccggtaagccagctcattaaactcgttcagcgataacctttctgtttgccggtgtttaaccggtgattaaccgtctacactgaagacaggaggccctatgaccctgtcttttactgcccgttggcgcgatgaattgccagcaacgtataccgcgcttttacccacaccgttaaaaaatgcgcgactgatttggtataacgacgaactggcgcagcagttagccattcccgcttcgttatttgacgctaccaatggcgctggcgtttggggcggcgaaaccttattacccggtatgtcgcctgtcgcgcaggtatatagcgggcatcagttcggcatctgggcgggacaactcggcgacggacgcggtattttgctgggcgaacagctcctggcggatggctcgaccctcgactggcatctgaaaggcgccggattaacaccctattcgcgaatgggagatggacgcgccgtcctgcgttcaaccatacgagaaagtcttgccagcgaagctatgcattatctgggtattcccactacgcgcgcgttatctatcgtagccagcgatacgccggttcagcgagagacgcaggaaacgggcgcgatgttaatgcgtctggcacaaagtcatatgcgttttggtcatttcgaacatttctattaccgccgtgagccggaaaaagttcagcaactggctgatttcgctattcgccattactggccgcaatggcaggatgtagcggaaaaatatgctttgtggtttgaagaggtggcggcgcgtaccggaagactcatcgccgagtggcaaaccgtcggtttttcgcacggcgttatgaatacggataacatgtcgattctggggctgaccatcgactatggcccctttggttttctcgacgactacgatcccggcttcattggtaaccattccgatcatcagggacgttaccgcttcgataatcaaccgtcggtggcgctgtggaatttacaacgtctggcgcagacgttaaccccttttattgagatcgacgcgttaaacagagcgctggatcgttaccaggacgcgttgttaacgcactatgggcagcgaatgcgccagaagctgggcttctttaccgagcaaaaagacgataacgctttactgaatgaattgtttagtctgatggcgcgcgaagggagtgattatacccgtacatttcggatgttaagccatacggagcaacagagcgcctcctcgccgttgcgggatacgtttatcgatcgcgcggcgttcgatgcctggttcgaccgctaccgggcgcgattgcgcacagaggcggtggatgacgcgctgcgccaacagcagatgcaacgcgtgaatcctgcgattgtgttgcgcaactggctggcgcaacgcgcgatagatgcggctgaacaaggagacatggcggaactgcatcggttgcatgaagttttacgtcaaccttttaccgatcgagatgatgactatgccagccgaccgccggagtggggaaagcggctggaggtcagttgttcaagttagccagatgccagcagaatcgtctgctggcgggagcgctatttggttaacagtagcttaccggcctgagttttgcgcaacagatactcctgaccgttgtgatcgataatgactttgccgtccggacctaatagcgcctgactgttgacgcgccgttcagcggcagggagaagcgtttcattgtctatttccttagggtgaggcagctcggtgttatccatacgcgacatgttatttattaataatcaaactcacaatgattattattatcaataattaatgcgataacagcaagtgctaattctgtggagtgatatacgcgcgcgtagagaaaagggtgggtaacgcatcgaagaaacgcccatcccggcaggatgggcgagctattaaaagcggctgtctaccgccgcggcaagtttttccaacagaacttccgtatcttcccagttcaggcagggatcggtaatggattgaccatagattaacggttgaccgctgataattttttgcgtgccttcccgtaaaaaactctctgccataatcccggcaattgccgtggagccattacgaatctgctggcaaatatcatcacatacgtccaactggcggcgatgctgtttttgacagttgccgtggctgaagtcgacgaccagatgttccggcagatcaaattcatgcaacgtgtcgcaggcggcggcaatatcttcagcgtggtagttcggttttttaccgccgcgcatgatgatgtgcccatacgggttgccactcgtttggtagatagtcatctgtccgtctttatccggcgagagaaacatatgactggcgcgggaggcgcgaatagcatcaacggcaatgcgggtattgccatccgtaccatttttaaagccgaccgggcaagagagcgcagaagccatttcccgatggatttggctttcggtggtacgcgcgccaatcgttccccaactgatcagatcggcaataaactggccggtgaccatatcaagaaattctgtggcggtcggtactcccagttcgttcacctgcaatagcaagcgacgcgccagttcaagcccatgattgacgcggtaactgccattcaagtcgggatcggaaatcaggcctttccatcccacgacggtgcgcggtttttcaaaataggtgcgcatgacgatttccagacgcgcctgatgcttttggcgttgtgcctggagctgcgtcgcgtattccatggcagcattcagatcgtgaatcgaacaggggccaatgacgaccagtagccgtggatcttcaccatttaaaatcttttctatccggcgtcgggagtcggtaacgtgactggcgacggaggacgatacaggataccgctgcgcgagttcggttggtgttaccaggctgtcgatacgcgcagtacggagttcgtcggttctgttcattacaagtctcagaaatttgttgtttcaacggcaggactaccgggaagtgatgggcatcacgataaaccaatccctgctgatttcaagtgcgaggcgtgtcacacctcgcaggcagaacggcatgataacaaaaaccaatccattaaactagtttactagtacatcctgcggttaagccccataatatcgagaatcttggtggctatctcttcaacggaataattggtgctgttcaggcaggggatctgattcttacgatacagcgcttcgacctccgccacttccatgcggcactgacgcaacgaggcatagcgactgttttcacggcgttcttcgcgaattgccgccaggcgttcagggtcaattgtcaggccgaacagtttatgttgtagcggttttaacgatgtgggcagcgtcaaattatccatatcatcggcgatgaaagggtagttagccgcacgaataccgaattgcattgccagatagagactggtgggcgtttttccacagcgcgaaacgccaagtaaaatgacctgggcctgatcgaggttgcgcaatgaaatgccatcatcatgcgccagggtataatcgatagcggcaatacgggcgtcatacttgttcaggttacccggattaagcccatgagtacgatgagcgatcggcgtcggatccagtttcatctcctgctgaagcggcgccaccagcgcctggacgatatcctggcagaagccttcgctctgcaagatgatggcgcgaatttcaggtaaaacaatcgagtaaaacaccagcgggcgaacgccggtttgctgataaatggcgtcaatttggtctttgacggcgcgggcgcgactttcgttttccacgaatggcagcgtgatgctgctgatcgtcaccggaaactgcgacataaccgcgtgacccaggacctcggcggtgatggcggtaccatcagaaatatagaaaacatggcgatcaacaacattatccattctgttcatcctgaagagtaaacataattatctgaaagcataaattaaaagtaacgggaaacgtataacttgtcgcttattttataaaatgacaggcactttttataattaatgaaaagtgtgtttcatttccttgaaacgcagtttatgccgggagtgattaagggaatgccgtgctatgcgcgggtttgcgcaactacgtaaacaatctgaaaaaatgaaaaaataaatttgcttgaacgattcaccgtttttttcgcgggtttaagtatgccaggataaatacgcaactatgtgtttcttaaactcgttcatttatcacaaaaggattgttcgatgtccaacaatggctcgtcaccgctggtgctttggtataaccaactcggcatgaatgatgtagacagagttgggggcaaaaatgcctccctgggtgaaatgattactaacctttccggcatgggcgtatccgttccgaatggttttgcaaccactgccgatgcgtttaaccagtttttggatcaaagcggcgtaaaccagcgcatttatgagctgctggataagacagatattgatgatgtctcccagctggcgaaagcgggcgcgcagatccgccagtggattatcgacactcctttccagccggcgctggaaaacgccatccgcgatgcctatgcgcagctttcgtcggatgatgaaaatgcctcttttgccgtgcgttcctccgccacggcggaagacatgccagatgcttcgtttgcgggtcaacaggaaacgtttcttaacgttcagggcttcgatgcggtactggtggcagtgaaacacgtatttgcttctctgtttaacgatcgcgccatctcttatcgcgttcaccagggatatgatcatcgcggcgtagcgctttccgctggcgtgcagcggatggttcgctccgatctcgcctcgtcaggggtgatgttctctatcgataccgaatccggctttgaccaggtggtctttatcacctcggcatggggactgggtgaaatggtggtgcagggcgcggttaacccggatgaattttatgtccataagccaaccctggcggcaggccgtccggccatcgtacgccgcaccatggggtcgaaaaaaatccgcatggtttacgccgccacccaggagcacggtaagcaagtgaagattgaggatgtgccgcaggaacagcgcgacattttctcgctcaccaacgaagaagtgcaggaactggcgaaacaagcggtgcagattgagcagcactatggtcgtccgatggatatcgaatgggcgaaagacggtcataccggtaagctctttattgtgcaggcacgtccggaaaccgtgcgctctcgtggccaggtgatggagcgttatacgttacatgcgcaggggaaaatcattgccgaaggtcgtgccattgggcatcgtatcggcgcaggtacggtaaaagttattcacgatatcggcgaaatgaaccgtattgagcctggcgatgtgcttgtcaccgatatgaccgacccggactgggaaccgatcatgaaaaaagcggcggcgattgtcactaaccgtggcgggcgcacctgtcacgcggcgattatcgcccgcgaattgggcattccggcggtagtcggctgcggcgacgccaccgaacgcatgaaagatggcgaaaaagtaaccgtctcctgtgcggaaggtgataccggttatgtgtatgccgacatgctggatttcagcgtaaaaagctccagcgtagataccatgccagagctaccgctgaaggtcatgatgaacgtcggcaacccggacagggcatttgactttgcctgcctgccgaatgaaggcgtaggtctggcgcgactggaattcatcattaaccgtatgattggcgttcacccgcgcgcgttgctggagtttgacgaccaggatgccgcgctgcaaaacgacattcgtgagatgatgaaagggtttgactcgccgcgtgaattttacgttggtcgactgacggaagggatcgcgacgttaggcgccgccttctacccgaaacgcattatcgttcgcctgtctgactttaagtccaacgaatacgccaacctggtcggcggcgaacgttatgagccgcatgaagaaaacccgatgctgggcttccgcggcgcgggtcgttacgtcgcagaaagtttccgcgattgttttgcgctggaatgcgaagcggtgaaacgcgtgcgcaacgatatgggccttaccaacgtcgaaatcatgatcccgttcgtgcggacggtcgaccaggcgaaagcggtcatcgaagagctggcgcgccagggacttaaacgcggcgagaacgggctgaagatcatcatgatgtgcgagattccgtccaatgccttgctggctgaacagttcctcgagtattttgatggcttctcgattggttctaacgacatgacgcagctggcgctggggctggatcgcgattccggcgtggtgtctgaactgtttgacgagcgtaacgacgcggtgaaagcgctgctatcgatggcgatccgcgcggcgaaaaaacagggcaaatatgttggaatttgcggccagggcccgtccgaccatgaagactttgccgcctggctgatggaagaggggatcgacagcctgtcgctgaacccggacaccgtggtgcagacctggctgagtctggcggaactgaagaagtaaaccgcgaccagataacgctatgcttatccggcctgcacaagaaacatgttgtgtcggccggatagggcgtaagttgcccgacgcctgcataatgccggatcaggcgttgtgcagaatcattaatacactgcgtagatcatttacggcgatttgccccggcgctgaagcctgcttcaccgcgccaaacgtggcggcagagccaaacacttcccctgccagacgtgaaatgacaccctctttcgccattgacatagtaattaccggacggtcggcgtaatgttgctgcatctccagcgtggcagtgagtaacgttaatacatcatgcttgctttgcggcataacggcaatcttgggaatatccgcgccgagtgcttgcattttacgtagccgcagaaccatttcctctgcggacggcgtctggtgaaaatcgtggttagacatcacgacataaacattatgcgcatgggcataatcgacagtggctttaacgtcagcatcaccggtaaatagctcaagatcgatcatatcgaccaggccgctgtcgattgcggcacgattaagcgtgagataatgctgagtggttattgtctgctcgccgccttctttggcgctgcggaaagtaaacagtaacggaatgtcaggcatcgcatcgcggataacacgcgcagcggtaagaacggattgagtcgatgcgatatccataaagtgatccacgcgccactccagaatatcgaatgtagcttcgcggtaggccagcgcctccgctttcacgctattgatgtctcttcccatcaacgacacgataattttgggcatcccttcgccaatgataagattttttacggtgacggttttcatgcgtgtcctgtcagttttttttcttctcgccattatgaacggtgaggctggccgcttgaagtaaaaaaaaaagcccatcgtaggagacgggcaaagactacacacagcaattcgttgtttcactcaggggatttccatgcttataaatcaatgtgttgatttataaccgtgtgctaatagtaggcatgagcactttttgcgtcgatcagattcgtctcaatagtttaaaaactgtaacggatttgcgacagaaatgagatgcggcggggaacagacgggcgaatcaaaatggggtgtgcgttgaattgataaacgtcgctaaagcatcgggcggcaatgccgcccgacgggattatgactgcttgttggcttcctcgatgtcatccagctcttcaaggatctcctctggttcattcgtcggcgccggaacttcatgtacccatgcggagaacaaacgccaggtcacggccagaagcaccggtccaataaacagaccaatcataccgaatgcaatcaggccgccgattaccccggaaaggatcagaagcagcggtaaatcggcgcccatgcggatgagtaccgggcgaatcacgttatccagagtgccgacgacggcgctccaaaccagcagcacggtgccccaggtggtgtcgcctgtccagtaaagccagataatggctggaatcaataccggcaacggccccaactgaaccaggcacgaaaggatcatcactaccgtcaacagggtagcgtaaggcacgccggaaatcgccagcccgacgccgccaagtaccgcctgtaccagcgcggtgaccaccacgccaagcgccacggcgcggatcgcctgggcagccagcagaaccgccgcatcgccgcgtttagccgcgagacgacaggcaaaatggcgtatacccatcgccacttgttcgccgcgccagtaaagcagggcgctaaacaacagcatcagggcgcagtgcatcataaagcgtccgatatgcgccgcctgaccgacaaaccagatcgtggttgtgccgatataaggccgcactttcgccataatagcgctaccgcccatatccagcaggctatgccatccggcatacagtttggcgccaactaacggaatattatttaaccatgccagatcgggtagcgtcatatcgccgccggtcactgcatggatgagcgggccgctaccatcgacaatgctgttcaccagcaaggcgacgggaataacgaagagcagcactaacagcagcgtcatgaccagtacggcaagcgagcggcggccccacaatattttttgtaatttcagcaaaacgggccaggtcgcgataacaatcgtacctgcccatgcaaaccccaaaataaaaggctgtactatccacaaacaggccacaatcatgatggctaaaaacagcaccgatagcagcacttgcgcaatatccctgggctgacgaacatttaccataaatacttttcacctttgtctttgcgccagaacgttggcgcgacgtgaacatgcaaaccacaccctataatgatgagcaatttcagcggtttttaacaggccgattctgcatgtaattctgttgggcgcacaggaaaaaaatgtgatacaacaaataacgcaacacgcaaacgattaagcatcccttcctgtgcgtagaccgctcgcgctcgccgggttgggcgccaccgttcacaacatagaccgcaggaaaaggtcaatataatgattccacaaatttctcaggcacccggcgtcgttcagctggtgctcaattttttgcaggcgctggagcagcaagggtttacgggcgatacggcaaccagctatgccgaccgtctgacaatgtcgaccgataacagtatctaccagcttcttcccgatgctgttgtgtttccccgttctacggcggatgtcgcgcttcttgcccgtctggcggcggagccgcgctttacgtcgctgatatttaccccgcgaggcggcggtactggcacgaatggccaggcgctaaaccagggcattattgttgatatgtcccgctatatgaaccgcattattgaaattaatcctgaagagggatgtgtgcgggtagaggcgggagtgataaaagatcagcttaatcaagcgttaaagccgtatggctatttttttgcgccggaactttccaccagtaatcgcgccacgcttggcggtatgattaataccgatgcctctggtcagggttcgctggtctatggaaaaacgtcagatcacgtcttaggcatacgggccgtattgttggggggcgatatccttgacacgcaatcgatgcccgtagatcttgcccggacgctgggtgaaaacacgacgacgccaggccgcatctatcagaccgtctatcagtcctgcctggaaaaccgtcaacttatcctcgatagctttccaaagctcaatcgcttcctgacaggctacgatttacgccacgtctttaacgatgacatgacccgcttcgatctcacccgcatcttaacggggtcggaagggacgctggcgtttattactgaagcccggctggatattaccccgatacccaaagtccgccgtctggtgaatgtaaaatacgactcctttgattccgcgctgcgtaacgccccttttatggttgacgcgcgcgccttatccgtcgagacggtcgattccaaagtccttaaccttgcgcgggaagatattgtctggcactccgttagcgaattgattaccgatgtgccggataaagagatgcttggcctgaatatcgtggaattcgcgggtgatgatgaagcgcttattgacggacaggtcgaggcgctgtgccaccgactggatggcctgatggcgcgtgcggaagcgggcgtgatcggctggcaactttgtaccgatttgacgggtattgagcgtatttacgcgatgcgtaaaaaagcggtagggctgctgggtaatgcgaaaggcgctgccaaaccgattccttttgcggaagatacctgtgtgccgcctgaacatctggccgattacatcgccgaatttcgcgctctgctggatggtcatggcttaagttacggcatgttcggccacgtggatgccggggtgctgcatgtgcgcccggcgctggatatgtgcgatccgcagcaggaactgttgatgaaacagatctccgatgaggtcgtcgcgctgaccgccagatacggcgggttgttgtggggcgaacatggaaaaggtttccgtgcggaatacagcccggcctttttcggcgaagtcctgtatggcgagctgcgcaaaataaaagcggcttttgatccgcataatcgacttaacccgggtaaaatctgtccgccgcaggggatagaggcgccgatgatgaaggtggatgcggtaaaacgcggcacctgggatcggcaaatcccgctggcggtgcggcagacctggcgcggcgctatggagtgtaatggtaacggcctgtgctttaatttcgatgcgaaaagcccgatgtgcccgtcgatgaaaattagccttaaccggatccactcgccgaaagggcgggcgacgctggtgcgggaatggctccgtctattggccgatcgcggcgtcgatccgttgaagctggaaaaggagctgccggaaaaacgcgccagcttgcgcacgctgattgcccgcacccggaatagttggcacaaacgcaaaggcgagtatgacttttcccatgaagttaaagaggccatgtccggctgtctggcatgtaaagcctgtacgacccagtgtccgattaaaatcgatgttccggagtttcgttcacgtttcttacagctttaccatacgcgttatctgcgcccggtacgcgatcatctggtggcgacggtcgagacctacgcgccgctgatggcgcgtgcgccaaagacctttaacttttttattaaccaaccggtggttcgtaatctggcgaaaaaacatatcggtatggtggatttacctctgctttctgccccttcattgcaacagcaactggtgggccatccgtctgccaatatgacgcttgagcaactggagcgcatgagcgccgagcaaaaagcgaaaacggtactggtagttcaggatccgtttaccagctactacgacgctcgggtcgtagcggactttatccgcctggcggaaaaactgggcaggaggccggtattgttaccgttctcgccgaatggtaaggcgcagcatattaaaggttttcttaatcgctttgcgaaaacggcgaaaaaaacctctgagttccttaatcggatcgccgcgttggggatgccaatagtgggcgtcgatccggcgctggtcctgtgttatcgcgacgaatataaactggcgctgggcgaacagcgcggcgattttcatgtgttgctggtgaatgaatggctggcgcaggaaataaatgcaagactgtccgtcgaggtaagcggtgaaccgtggtacttttttggtcattgtacggaagtcacggctttacccggcgcgcctgcgcagtgggccgccatctttgcccattttggcgcgaagctggaaaatgtcagcgtaggctgctgcggtatggcgggcacttatggacatgaactcaccaatcataaaaattcgctgggaatttatgagctatcctggcatcaggcgatgcaacgtctaccgcgaaaccgctgcctggcaaccggctattcctgccgaagccaggttaaacgcattgaaggtacgggcgtgcgtcacccgttgcaggcattactggagattataggttgatctggaaacgtgaagtgaccctcgatgcgcttaatgcgatgggggaagggaatatggttggcctgcttgatatccgctttgagcgtattggggacgatacgctggaagcgacaatgcccgtcgatcatcgcaccaaacagccgttcggcttgctgcatggcggagcgtctgtggtgctggcggaaagtatcggctcggtcgcaggctatctgtgtacgcagggggagcaaaaggtggtggggctggaggtgaatgccaaccatgtacggtcggcgcgtcaggggcgcgtacgaggcgtctgtaaagcgttgcataccggggctcgccatcaggtctggcagatagagatctttgatgaacagggacgtctgtgctgttcttcgcgccttactacggcgattgtgtgacgttgtcaccataaaagtgtgatgcatattgcttttggtcaaaatgtgcgcagaaaaaggtgatatactgtgcacgtttacacataagcgaggatgatatgtctattgatttagacccaacccaactggcgattgaatttttacgccgtgataaaaccgaactttctcccgcgcagtatttgaagcgtttaaaacagctggagttagagtttgccgatctcctcaccctctctgcaaccgaactgaaagaagagatctatttcgcctggcggttgggcgtgcattaatagagtctgtgtaggccggataaggcgttagccgccatccggctatgttaccaggcaatctcaccagacactgtcccccggtaatagataacccccttgattttgtgtaaaaaaaatacagatcgccatttgtgctaaaaaggtgcgctctctttatgagattattcttatgccccttcaagagctaagccattaagagtgccggagataagcgccggatggggccggaacccttaagcctgtattgaacagacttaagggtttttcttttccgggcgcgtaaaaaactaaggtctgtcaataaccgctggcatgtcgtcagccctattattattcaaaatacggttagccagcacacctgacatcatcgatccgttaacgttcagagccgtgcgggccatatcaacgataggttcgatggcaataaaaataccgaccagcgcaacgggaaaattcaacgtcgacaggacaatcagcgccgcgaacgtaccaccgccgccgacgccggctacgccaatagaccctagcgcaatggcaggcaacatcgcggccagaaaatgcagcgagagcggatcgatgccgatggtgggcgcaatcatcgctaccataatagccggataaatcccggcgcagccattttgccccatactggagccaaacgaggcggaaatattggcaatggtgctttgtacgccaaatttttcctgggcggaaatggccagcggaatagaggctgcgctgctgcgggagacaaacgcaaaggttaagacgggccagaccattctgaaataatgcgctggattattaccgctgaggatcagcaagatggcgtgcacgataaacatcatgaaaatcgcgatataacaggcgccgataaaaccaagtaagctggcgaattgttcaaggcggtatgatgaaaatacggtggtcattaatgccatgacgccatagggcgttaatgcaataacgatacgtaccatcttcatgacccagatctggatagcgttaatgcctgcgcttaatttctgaccttcttccggcgcctcttttttgacctttaacagggcgatccccgctattagcgtgaagataacgatgccgataacggaaacacttctggctcccgtaagatcaagaaaaatatttgtcgggatcagcgatgtcactaactggggaatcgacaccgcggcagtcttattgacttcttctgtagttaacattgacggcatgtgcacaaaagcgctggcgtcaagccccagtatatgagcggtcagtaatccgataaaaccggcaaccatcaccaggcataacatgcatccgacgatcgtcagcgacatttttccgatgccggcgctattttccagtttattgatggcggaaagaatagaaataaaaattagcggtatagcgaccagttttaacagatggacgtagccattgccgacgatgctgtaccattcgataatggttttagtgtgatttgctgaaataaaatgcagggataaaccaataacagcccctaaaaagatagcgataaaaacgcttttcgacagggaatcgcttttttgattaattctcaagatggcccacgagaaaaccaaaaaaagtgcgatatacgcgagcgtaacaaccatattttaagcctcttgcctcattcagcacctgaaatgccggaaagagtttacataaacctatagctcaaactgagttatagaaccgcagcggattataaagagcgcaacgccaggtatccatacaaaaaatggggttctgacctcgccgcccggcaatgtcgacagcctattaattaaatagtcattttctatacatcttttcgtttttgacctgccagaacggttaatgtcttataaatcattacttatcaaaaagttaagtggttttttgtctgtcgtatgacctggcggacagggtctatgcttaataaaaggcgctcaatatgaccatttgttggaaagcccctgcggttaaggggttgaagtgataatcattatcactaacatgctgttatatcctggtgatttagaacgcgaggtaactctatggaattgcattcaggcacgtttaacccggaggacttcccctggcaagggctgacgctaacgccagcggcggcagcgcacatacgtgaactggcagcaaagcagccgggcatgttgggcgtgcggttaagcgtaaaacagacgggatgtgccggatttggctatgttctggataccgttcgggagccggataaagacgatctggtttttgaagccgaaggcgcaaagcttttcgcaccgttacaggcgatgccttttattgacggaacagaagtggattacgtacaggaagggctgaaccagttatttaaatttcataaccccaaagcccagaatgaatgtggctgcggcgaaagttttggggtataggcggtactatgtctcgtaatactgaagcaacggaagaggtcggcatctggacaggcggacgccttaattacaaagaaggatttttcacgcaattacccactgatgaactggcaaaaggcatcagcgaagaggtggtgcgtgcgatttccgcaaagcgtaacgaacctgattggatgctggaatttcgcctcaatgcctatagagcctggctggacatggatgaaccgcactggctgaaagcgcattacgataaactgaactatcaggactacagctattactctgcgccatcatgcggaaactgcgacgatagctgcgtttcccagccgggagccgtacagcaaacgggcgcgaatacctttttgagtaaagaggttgaagacgctttcgagcaacttggcgttccggttcgcgaagggaaagaggtcgccgttgatgcgatttttgactcggtctccgtagcgaccacataccgtgaaaaactggcggaacagggcattattttctgttcttttggcgaagcgatacacgatcaccctgacctggtcaggaaatatcttggcaccgtcgtgccggggaacgataacttttttgccgcgctgaatgcggcagtcgcttccgatgggacatttatctatgttcccaaaggcgtgcgttgcccaatggagttatccacctattttcgcattaacgctgagaaaaccggtcagtttgagcgcacgattctggtggcggatgaaggcagctatgtgagttatatcgaaggctgctccgcgcccgtacgcgacagttatcagctccacgccgcggtagtggaagtcatcatccataaagatgctgaagtaaaatattccaccgtacaaaactggttcccgggcgacaacaacacgggcggcattctgaactttgtgaccaagcgggcgttgtgcgaaggggaaaacagcaagatgtcgtggacccagtcggaaaccggttcggcgattacctggaaatacccgagctgcattctgcgcggtgataattctatcggcgagttctattccgttgcgctgaccagtggacatcagcaggctgacaccggcaccaaaatgatccatatcggtaaaaacacgcgctcaaccattatctcaaaaggcatttccgccggccacagccagaacagctaccgtgggctggtaaaaattatgccgacggcaaccaacgcccgaaatttcacccaatgcgactccatgttgattggcgcggactgcggcgcgcatacgttcccgtatgttgaatgccgcaataacagcgcgcagctggagctcgaggcgacgacatcacgcatcggtgaagatcagcttttctattgtctgcaacgcggcatcagcgaagaagacgctatttcgatgatcgtcaacggtttctgcaaagacgttttctcggaactgccgctggagttcgccgttgaagcgcaaaaactgctggcgattagccttgagcacagcgtcggttaatgatgaaggaaaacccatgttaagcattaaagatttacaggtcagtgtggaagaaaaggcgattttgcgtggcctgaatctggatattcgccccggcgaagttcacgccattatggggccgaacggttccgggaaaagcacgctctccgccaccctggcgggacgtgaagattatgaggtcaccggcggctcggttacgttcaaaggtaaagatctgcttgaactgtcgccggaggaacgggcgggcgaagggatttttatggccttccagtacccggtagaaatccccggcgtcagtaaccagtttttcctgcaaaccgcgctgaatgccgtgcgcgcctatcgagggcaggcgtcgttggatcgctttgattttcaggatctgatggaagaaaagatcgcattgctgaaaatgccggaagatttgctgacccgttcggtaaacgtcggtttttccggcggggagaaaaagcgcaatgatattttgcaaatggcggtgctggaaccggaactgtgcattcttgatgagtcggactccggactggatatcgatgcgttgaaaattgtggcggaaggcgtcaacgcgttacgcgacgataaacgcgcttttattatcgtgacccactatcagcgcatactggactacatcaagcctgattacgtccatgtcctctatcaggggcgaattgtccgttccggcgattttactctggtcaaacaactggaggagcagggttatggctggcttaccgaacagcagtaaagcgctacagcaatggcagcatctctttgaagaaaaaggagaaattcgaactgagcaggcaagacaacatttccaacagatgttacgtctgggattgccgacgcgtaaacatgaagactggaaatacacgccgctggagggcttaacccatagccagtttatccagcagtgtgcgactatcagcgccgcccagcgtgatgcgctggcgctgcaaatcgatgccgtgcggctggtgtttgtcgacggacggtttatgccagagctcagtgatagcacgcaaaacagcggatttgacgttagcgtcagagatgagcgccagacgcttgccgcgccggtacatcccgaggtttttctgcatctgacggaaagcctggcgcaatgtgtcacgtatatacaggtacggcgaaatcagcgtccgaccaggccgctactgttaatgcatatcacgcagggcgtggatagcgacgagctgaataccgcgcattatcgccaccatctgacgctggcagaaggcgcggaagcgacggttattgagcattatgtcagccttacagcggcaaaacattttaccggcgcgcgtctgacgatgaacgttgcagacaatgcgcaactgcgtcatatcaaactggcgtttgaaaatgcgtccagctatcactttgcgcataacgatcttctgctggcgacagacgcctcggcgtttagccacagttttctgctgggcgccgcagtactacgtcaccacagcagctcacaactgaatggcgaaaacgcgacgcttcgactgaatagtctggcgatgccagtgaaaaatgaagtctgcgatacgcggacatggctggaacataacaaaggctactgtaacagccgccagttgcacaagaccatcgtcagcgacaaaggacgcgcggtctttaatggcctgattaacgtggcgcaacactccattaaaaccgacggccagatgaccaataataacctattgttggggaaactggctgaagtcgataccaaaccgcaattagagatctatgccgatgacgtgaagtgcagccacggcgcgacgatcgggcgtattgacgatgagcagatgttttatctgcaatcacgcggcatcaggcagcaggaggcgcggcacatgattctttacgcgtttgccgcagagttaacggaagctatccatgatagcgcccttaaacagcaggtgctggcgcgaatcggccagcgactgcccggaggcctggtatgacatttcctgtagaaaaagtacgggcggattttcccatactgcagcgtgaagttaacggcctgccgctggcttacctggacagcgcagccagcgctcaaaaacctaatcaggtgattgatgctgaatctgccttctaccgtcacggctatgctgcggtacatcggggtatccatacgttaagcgcgcaggcgaccgaaagcatggagaatgtgcgtaagcaggcgtcgcggtttattaacgcccgctccgcagaagaactggtgttcgtgcgcggtacgacggagggcattaaccttgtcgccaacagttggggaacggaaaatattcgcgccggggataacattatcatcagcgagatggagcatcacgccaacatcgttccctggcagatgctgtgcgagcgcaaaggcgctgaactgcgcgtgatcccattgcatcctgacggtacgctgcggctggagaccttagctgcgctgttcgatgaccggacccgactgctggccattacccatgtatctaatgtgctggggacggaaaacccactgccggacatgattgcgctggcgcgccagcatggggcgaaagtgctggtggatggcgcccaggccgtgatgcaccatgctgttgacgtccaggcgctggactgcgatttttacgttttctccggccataaactttacgggccgaccggcatcggcattctgtatgttaaagaggcgttgctgcaagaaatgccgccgtgggaagggggcgggtcgatgatctcgaccgtcagcctgacgcagggaacgacatgggcgaaagcgccctggcgttttgaggcgggaacgccgaatactggcggcatcatcggtctcggcgcggcgattgattatgtgacgtcgctgggactggataagattggcgattatgagcagatgctgatgcgctatgcgctggagcaactggcgcaggtgcctgatatcacgctatatggcccggcgcagcggttgggcgtcatcgcgtttaatctgggtaaacaccacgcttacgacgtcggcagctttcttgataattacggtatcgcggtacgaacggggcatcactgcgcaatgccgctcatggcctggtatggcgtgccggcaatgtgccgggcttcgctggcgatgtataacacccatgaagaagtggaccgactggtggcaggattaacgcgtatccaccgcttattgggataacagtgaggttttatggctgcgctaccggataaagaaaaattgctgcgtaactttacgcgttgcgctaattgggaagagaaatatttatatattattgagttggggcagcgcctggcggagttaaatccgcaggatcgcaatccgcaaaatacgattcatggctgtcagagccaggtgtggatcgtgatgcggcgaaacgccaatggcattatcgaattgcagggcgacagcgacgcggcgatcgttaaaggccttatggcggtggtatttattttgtaccaccagatgacggcgcaggatattgtgcattttgatgtccggccatggttcgaaaaaatggcgcttacgcaacacctcacaccttctcgttctcaggggctggaagcaatgattcgcgcaattcgcgctaaggccgccactcttagctaaactatacagacagcgttctacctgatgtcaaatcctttgtcggacggcgacgtcgctttatccagagtggacagagcgtatattttgttgttctgataagcgaagcgctaccagccgtcgcagagggcatcaccaggaatacaggaggtttggtatgaaacgtgcgtctttcattacgctaactattatcggcgcgtatagcgcgttacaggcagcctgggcggttgattatccattaccgccagaaggcagccgtcttattggtcagaatcaaacctataccgtacaggaaggtgataaaaacctgcaggctatcgcccggcgttttgatacggcggcgatgctcatccttgaagcgaacaatacgattgcgccggtgcctaagcccggtacgctaattaccattccctcgcagatgctattgccggatgcgcccagggaaggcgtcatcgtcaacctcgcggagctacggttgtattttacccgccgggagaaaaccgcgttcaggtgtatcccatcggcatcggtttgcagggactggaaactcccgtcatggacacccggatagggcaaaagatccccaacccgacgtggacgccgacggcaggcatacgccaacgttcgcttgagcgggggatcacgctgccgccggtgatccctgccgggccaaataacccgctgggacgctatgcgctgcgtctggcgcacggtaatggggaatatctcattcatggcaccagcgcgccggatagcgtaggtctgcgcgtgagttccggttgcattcgcatgaacgcgccggacatcaaagcgttatttgcgcaggtcagaacggggacgccggtaaaagtgattaaccagccggtgaaattctctgtcgagccgaatggcattcgttatgtagaggtacacaggccgctatcgccggaagaagagcaaaacgtgcagacgatgccctatgtgttgcctgcggaatttaccgcgttcagaaacgcgcaaggggtggatagtcgcctggtcgataaggcgctataccggcgagccgggtatcctgtcagcgtgagcgccggacagacgccagcggtaaatacgaccgcagtcgaatccgctcagaacggttttgtcggggaagaggggcaaacgcgcgcgacgcagtagccttcgcagtaaatgacggacaaaaaaatggcgcacgatgtgcgccattttatatcatgcgtcaaatcatttacagatgcggaatactttgttgtccagacgttggttagcgcgagctgcgtcgtctttagcagcctgaacgtcggaacgcattgcatttacgtcattactcagttgatcaactttagcgctcagcgtctgtacatcggaagacaactgatcgattttagcgttgctggaacaacctgccagtaacgtggaacccagaactactgcacctaagatcagtttgttagtgcggttcataacaataaccttatattttgtgtggttatataggtaaaaaaaatggcgcacgatgtgcgccatttttattacgcaggtactattacttacggtatttagtagcctggttgtccagacgctggttagcgcgagctgcgtcgtctttagcagcctgaacgtcggaacgcattgcgttcacgtcgttgctcagctggtcaactttagcgttcagagtctgaacgtcagaagacagctgatcgattttagcgttgctggagcaaccagccagcagagtagaacccaggattaccgcgcccagtaccagtttagtacgattcattattaataccctctagattgagttaatctccatgtagcgttacaagtattacacaaacttttttatgttgagaatatttttttgatgggaatgcacttatttttgatcgttcgctcaaagaagcatcgaaatgcatgaaagtccctaaaaaaccgaaagaaaacagggggcttccatcggattcttcttagataatccgcaattagatagtaaaatccgatttgatttttttattaatagtggctatcgattaaataaaaaaagcgccggaagggcgcttttttaaacaaattaattcacacaacaattattacagtacgtgaacagaggcggtgttagtggtgccgcttggaaccagcgcgccggagaccatcactacgacgtcgcctttctgggcgaggccgctttgtagggcgacatctttgcccagacggtagaaatcatcagtagaattgatttctttcaccagctgcgataccacgcctttgctcagtactaactgacgggcggtcacttcattggtggtcaatgccaggatggtggcgtccgggaagtatttacgcacggcgcgagcggatttaccgccctgggtcgctaccacgatcagcggcgcttccaatttttcggcggtttctaccgcgccgcggcataccgcttccgtaatgcgcagtttacggctgtcgttgttgtagtccagacggctgttcatgacgcggtcggtacgttcgcagatggtcgccatgatagaaacggcttccagcgggtatttcccttttgcggattcgccggacagcataaccgcatccgtaccgtcgaggatggcgtttgcaacatcgcctgcttctgcgcgggtcggacgcggatttttgatcatagaatccagcatctgagtcgcggtgatcacgactttacgtgcgcggatacatttttcgatcatcattttctgcgcaaagatcacttcttcaaccgggatttctacgcccaggtcgccacgcgcaaccatgatgccgtcggaagcttcgagaatttcatcgaagttgttcaggccttcctggttttcgatcttagagataatctggatgttttcgccgccgtgggctttcagatgctcgcgaatttcgacaacgtcagaacgtttacggataaaggacgcagcaacaaagtcaacgccctgttcgcaaccgaagatcaggtcctgtttgtctttttcagccagcgccggcagagcaatagaaacgcccggcaggttaacgcctttgttctcgcccagatcgccgttgttcagcaccttacaaatgactttattgccttcgatggcggtcacttccataccgatcagaccatcgtcaaccaggacggtgttgccaacgctcaggtcgctggtgaagccttcataggtgacggcaacgatttcattattaccgaccacggatttgtcggtggtaaaagtaaaggtttggcccgctttcagcgaaacgtcgttaccgccttccagtttaatggtgcggatttctggtcctttagtatcaagcagaatagcagcttttttaccagttttgctcatcacgttgcgcaagttctggatacgctgaccgtgttctgcataatcgccatgagagaagttcagacgcatcacgttcatgcccgcgtccagcattttgcttaacatctcttcggattcggttttcggaccgatagtacaaacaattttcgtctttttcatgacagtcttagtctttaagttgaggaggatatggaaatctggcttcgggcgcgcacggcccgtaagctaagcctgtgttgctaaagtgatgatgcctcgctctaaggataggtgacatcgaaagagcgtgcagaggaatgtgtgctcgcgtttcagcccaacgggaaggggataattttagtcgttgagttttacagtccaatgcgctgaaaccattcaagagacaattggcgcgcattatacgctgaaatttacaaaaaaggaaaatgaaaaccctgtttcaaaagacatctgtgcagatccacaacggtttgttattacgctgtttacgatgtcgctggcgatgacgccgcccgaacaggggcggcgttgcgcaacagctggtgttgttgcgcataatgtcaatcgagcaactttttgccttccaggtcgatggcgatgttttggttgtatgcttttcggtagcacagtatcgctatcccgatcgccgcccagctaattccgagtatcagagcgtgaatgttcatgtttaaacagacgtagccgatgacgatcatccccatgatcggcgaaatgacatgggcgaaaatgcgccgctgggctttcatccggaaattgaacaggataaacacacacaggttcacgacaaaaaaagcgaaaagcgcgccaaagttcaccagcgtggagatagattcaatcttgccggaaaacaggtagctgagcagcagggtgacgccgccggtaaacagaatggcataatccggcgttttacgcgtggtatggacgtgagcgaggaaggcgggcaacattcggtcgcgccccattgaaaataacactctggacaccgccgtttgcgcggtaataatgttgccgacggcgcacacaaacgccacaatgatggaaaacgccactttgagccagataccgccaacgttgccggcaatggtgaaaaatgcttcattcgtcgcattaccttccgcgaagcggtcgacgttaccggtggcgaacgccgcaaacgccacaacgataataaacagtaccgtcgccaaaactaacgccaacagtgttgctttactgacggcgcgtcccccgccttcgctttcttcacttaatgtactgatagcgtcaaagccgagaaaattcagcgcagccaccgaaatcgccgttgcgatgagcccaggggtgaaccactgtgaatcgaaaaaaggccggaaggaaagcgttatctgactactgtcctgcatcatcagacggataatgagtagcacgaaaatcgccagaataccgagttgaataaagaccagtaacttatcgaatttcgccgtttgctgtatcccgagatagttgactccggtgccaatagccacataaatcaacggccagacccagaccgggatttgcggtaaaatagcgtggaccgcgacaccgcccagcaccgctacgagcgtagggaacaaaagataatccagcagtaatatccatccggtcagaaaccctacggcgggattaatgcatacgccagcatacgcataggccgaacccgacgaggagatatgctgcgataaggtagagtagctgtacgcggtaaaaaacatcgcgatagcgccaataatataaaccagcgcaaccataccgtgcgaaagattataaacgacgccataaagagagactggtgcgataggcaccataaacaccagaccataaagcactaaatcggtaagagacaattttttgacttttttcatgataaatatcttaatggctttttatgccagatcgcgtaaaaacgcgcttacctctgcgaggcagggcgcgatattttcttcatgcgggttatggctgctgccaggaatagtgaccgcgcggcagtctgaaatgtgagagagcagcggagagacgacgcgctcggttgcctgatcgttttcgccgcgtagtaccagaacaggacagcgtatctggcacaaatggggcgtaatatcccagtcggcaagtttgccatttgccgccagttcattggttccccataaaatgtgataacccgtagggtcggcggcgaactggccagtatcgtcccgcgaagcccggcaggctgtaagcaggcgtgctctgcggcaagcattccgccccaggaatgtcccagtatcgaatacccgtgcccaatacccaggtgatgaattaattgggttaattgacggagataacgcgcaatagtccagaaagacgcgtcggcatgaggaaaatgcgttgaacgaccgcaaccatattgatcgtaaaatattaccatgcgcccgtcatcagccagacggcgataatttaataaataatcaaagccgccagaagggccgccatgaaggataatgagcggcgtgagtaatgattttctgtcgccataaatccgatagcttgtcaatatgttttcagaaaacatttcgccatagagataagtatcattcatattcttaatgactcagtgtgtggcagggcaggcgaaatttatattcgcctgggtaatattatttttttattgtgtgtaaaacattacaccagaaggtggcgtaatgttcccattgcagaaactgcggacttccccagtgcggcgaacaatcactggcaaagcaacatactttccctttatggtaagtacccataactaacagtggatcgccattaatttcagcaaggacctgactattttctttggcgataagcttgttatagcccaacagcggcggccattcgctaaatggctgggtaataacatgttttaccgcagtatttactgctttacatccttgcggtagttctacgcggtcatctacatccagcatatcaaccggcaatacctccgccagaaccgtatttttataattggcttttgcttctattcccgtaaaggataaatacccgccgatcattaacagaccgccgccctcagcaacataatcggcgataagttgtaatgcatcaggaataatgtccatattataaaaggttctgttttgtaacaggaacgtattgctaccgatatcactgatgacgatcgcatcatagcaggctaatgcttcggcggtttgtggaaaacgagtttgcacaatatgggcaggcatgtagtccacatcgatattaccctggcgtaagcaggataataaatagtctgcgccttcttcgtatttgctcgatgtaaagctatcaaaacctttagagtgaatcatatgaatgtgccaggattcgccaataaataagattttcattatgtcacctgttaattaatgtgaatgactttattagattgggtacgcattcgatgtaaaacctgcaagtgctgaggcatactcgacgcaccgacttgttccaccgccagagaagcgaaagcggaggcatattgaatggctgcgaccatatctgcttgtcgcgccagcgcggcggctaaggcgccattaaaagcgtccggcggcatcttttaccacggcgctccacgcaggaatatacaacgtgcgggcgtgctcacagagcagagaaccacgggcgccaagggtaatgatgacttttttcaccccggattgcagaataatatttccggcttttttcgcatcattaatatcagtaatggttacgccggataaaaaagaggcttcagtttcattcggcgtgatgatgtcaatatcagataataaatgcgtcacctgtttcgtatagggggcaggattcagcatgatcattttattttcttgtttgcccaggcgaataaattcagtcaacgcttcaatgttcgtttcgagctgcattaacataacgtcagactcggcgatataacggtgttgctcgttaatctcttgcgtggtgagcatcatattggcgccagggtagatggcgataatattatcgccatccacggcggagacatagatcaatgcgctaccggtgggcgctttatctgtttgatacgcgctgtatgaggtggtgcctgattgaataatatgattcatagcaaatgcgctgaactgatctttgcccactttaaaaataaaatgcgccgcagcaccagcattgtttgccgctaaagcctggttggctcctttaccgccaggatagaatccaaattgactggccagaatggattctccgctttgtggaaaccacggcacggttgctgaaacatcaatattgaatgagcctaaaacacacaccttgcctgctttttttgtgttttcccggtgcagttttgcatcctgatggattggcgtggcgatagtgctggagatatcaatcttattttcagtgataagcttactcagcgcgtcacggtttaaaatccctccgccatagcaacgctgaagcatacctgatttctggaaatagcgtagatcggaacgaatagtctcctggctaaccttataaaggtctgaaagtttactgacgctaacactattatcctttatcagtaaattaatgatggcatgacgtctttcttctttaaacatattgcctccgggtagtgagttgaattgtatttatggcaatattgtcatgcggtgaattcaatcacagattatgcggtcaaccggaagtaatcccaaatgaatgtcaataatcagaagcgcagccaatgtgttaaatattaattgcttacagaaggggaaaatagttttgtgagtgttgtcatatattttctatgtaatatgacggggtgaacgtaaaatagttgggcttgcacgattcagtgagtatatgcagccggacagcattcgcttatcagtcgctaccctcgacgaaataagacgatatcgctctccggccctggggttatatacgctcgatttttgccggcagcccctgacgtaccgccgcgccagaaacccagtcgagccaggtgttggtaatggttcttgtcggatcagcaaagcccagatcgttaagatttatgcctgccctgatttgtggatcatacggcataggcacgccgtccagagagtgctgcgttgcgcccatctcgcggtggccatatccgtgttcgatggcgatgacgcctggcatcacgccatttaacaaactgatttgcgccacgacctgaccgcccggcgtaatgatccgtacccgatcgccatgttgcagtccataacgctcgccgtcttgcggattcagcgccaccaggtttgctggcttcacatggtgtaagcgcgggatgacggctgttgagctggacatggtatttgatttaaatgaaatcagtttcagcggccactgtccaatgggaaactggtcgtcaatcgcacgaccatctgacagacgcgccggataccagaccgggcaaccgctgaagcgctccccggtgatggcgtgacggtgggcggcgacatctgcattccagatctgtaagggttttttccacgcgttacctaaccgttgctccgtatagccgctatcttcgggcgcaaaccggccgccacgcgagtagataaacgccacgcgaccgacctcatcagctttaagcgtgtgctgaattgctggcagaatgcggctgacgccggtaagcgaaatatcttcctgatttgccagcgcgaccggcgtcttgcccataaaggcgatattagcggctacgcgcagatagaagtcttccgcccggttcagtggaaaagtattgccctgcggatcggttatcgcccggtcgccgaagccgggcagatggagccgttttgctaccgcaatacaaaatgcttccattgagacaggttgcccgtccgccgttcggtgagtggcgggggcgacaaccggccagcgggcggtagtggctttactggctacgccgccccagggcgccgtaaagccccagctctcaaaattgtgcgtatccggcacaatgtaatccgccagcgccgtcgtttcattcataaaggcgtcaatcgcgataaagagcggcagtcggcgagggtcttttagcttttcttccgccacggcgcgtagaccgggaacaccgtaaaacgggttgctcatattggaaatccaggctttaagcggataaggatagccttcgagcgcggaggtcaacagttcggtaagctggcctgccacaaagggataccatggcgctttggctggataaggggattgcccgccggcaattttgtcgcggtattcttccgatgctttataagcggttttgctacgggcaatactcaacccggacggtttcacttttccggcaaaactgttcatgttgtagcgggggccgtcgctaacgccgttgaatttgccgccgccgacaaagacgccgccggacaagctgaggttgccgatcagcgcgttaagcatcatgactgaccaggtgttataaaacccattgccggccatcatgccgccgtgactgatgaccgcagctttacgtccgtgactgataaaggtttccgccagcgcgataatttgcgcttccggcacgccgcactgttcgctgtattgcgccaacgagagcttttctgccgcctctttcaggcgttgcaacccgctcttcaccgtgacccgttggccgtcggcgagcgtaacgtactgcgtcacgaaaagccgtgcctgtcggcaagtggacgcatcgaccaactcgccgtcggtattcagcacgacgggggtctcttcgccatcgggcgtaagatggcgcagcgtcaggtgttgtccggcaagcgtcggcagttcatccgcaatgaccaggtgcgtggcgttggtccaactttgctcgccggcctgctgcatcgcctgtacgccgggaatcgccagataatcagcattataacgttgattatccatgatccagcggatcatccccattgccagcgccgaatcgctgccgggcatgaccggttgccagcgaccgcgaggatcggcgagcaccgttgataaggggagggcgggggcgaccacgacgtattgaaaattctcacgcagccgggcgctcgccaactgacgcgcctggcgtttaaagggattaccggactgtgccggggaggtgcccataaagagcgcaaactccacgttttcccagtcgggtttgacatgcgggtttttatccagatcgcccatcaatgccccggagccggcccggtaagccagtccacagtaggcgccatgcgcgccgaaattcttgctgccgaagctatttagcgcaaaacgacgcagaaacgcatcgcggccttcgtcgctggtattcgtgaccagtaactgattggttttgggcccgaaactggggtgctttgcgtcaattggcgtatccggcgcatgaatagcgcgcagtccgtccacatgaccttcgccaaacagatcgccgccttccacgacttcttcaataagctgctcaaagctgatgcgctgccatttcccttcgccgcgtttacccacgcgtttcatcggttcaagcagtcgcagcggactgtacaggctttccagcagcgtggcgccgcgcgcgcaggcggttgagcgggcgtcaagaccgctttctcccgccagttgctccatggcttcgctaaaagggacggacgagtcaatcgggtgttcctgcgacaaggggtgatagggattgccggcgatgcgtattactttgccatcggcatttacccgggcgcggataccgcactgtgtccaacagccgaagcattgcgtcatggcgatggtttgttgtggattttgctgccagtgcgtttgtgcctgcgcctccggaattaacgcgttgccaaagatgcggtcgcgcgttaccttgccggatgtcccgtttaacaggccatcaattgcgcgtttcgccacatcacggtagctcagaccaaaagtgaccatcccaccgacggcgagaccgacttttagccactgacgacgggttaaattagccatgttgtaatctcctggtgagtccgttcagcgtttcacgaatactaatcagtagcgctatccacaggccgaaggtgccgagaatagccagccagccatccgttccgcctggtaacgtgtaagggttaaattgcgcgttgaacttgggtacggtttgtacctgaatcaacaatgtccagcgcatcagccaacatagcgccagcgcgctcagaaccagcaggacgcgtcttagctccgataacggatgacgtagcgccaggctacagaacagcagtgtgaatacccacagcgctagccagccgacagcgtaatatttggctgacagggcgacggtaatccactgacggattgccgtgccggaaagcgtatcgccgctgacccacatggccacaaccagccccagcgccgccagcgtccagagttgtccccacagtatttttggcagccttaccgagtcgcgtcgggcggcgacaatcatcagcgcgaagaacgcctgtaaggcgctaagaaacatcgccacggggaaggcgtagctaaaccagattgggcgcgccagcacaacggagacttcgcggccggtataaatcaacaggcccaccgcgcaaagcgcgctggctaacgccaaccatttagtgacgttgtaacttttattgaataatcgttttatttgctgcgccaggaaccacagagcgagaaatccggtaaacagcggcaggaacaacgctccccagggcatccacgaccagggcgtcggccaggcatagaaatgccagacgcgggcggtctggtgcagatccgccgtcagcgccagcggtgcggtaatcgcacaggtaatggcaatcagtaatgcccgattttcttctgttgcggcgtcttttttccgccagtgaagataacaggcaaacagtgcggcgcaggcggcaatgccaataaaaaagaaatattgtaccgcccacggcagccagctaatgtcctgcgggtgagccagcacttcttcaatgatgagtgaatgcgtcattcagacctcctgccaaagcgcgggctgcgcacggcccattaatggggtgacaaaggcgtcgtccagacccaggtagaaaacatggggcgacgtgccgttttccggctttaataccttgatagcgtcgcgatgttgatgaagcatggtggcgatgcggctatggggatctttgatatcgccaataatacgcgcgccgccgacgcaggactctacgcaagcgggtaacagtccggcttccagacgatggacgcaaaacgtgcatttatcggcagtttgcgtttcatgattgataaatcgggcgtcgtaaggacacgcctggacacaataggcgcagccgacgcagcgtttgttatccaccaccacaatgccgtcttcccgctgaaaggtggcttgtaccgggcagaccggcacacagggggggttatcgcaatggttgcacagacgcggcaacagcacattcgtgacttcctgactaccttcacgctggacctggtattggttcacggtcgtacgaaacgcgccctgcggcgtttggttttcaatagtgcaacttacggtacaggactgacagccgatacaacgccgcaggtcgataagcatggcgtaacggtgtcggggagagccttcatgccgctccggcgaaaaaggaaatttcgcttcagccagcggaaccagcgaggcgccagcggtcaggacgccgagctgctggagaaattgccgtttactgctgtccatattgactcccgtccacattgccaacaatgaaacatttgtcacgatgttggttcatgtgtaatgaataaaaaatgttgatgatttacagtgtaaaaatcgagacggggtgcgctctattgtggttaaccacatacccggcttgttgttgatctaaaacaacataattgacagggatattggggtgagaggtaaaaccgtaaggcgcctggcggtgttggcggcagtagggctactttgtcatggcgcgtgggcagggacgtggaatatcggtattttggccatgcgcggcgaggcgtctacgcgtagccactggcaaccgttggcaaagacattaagccaacagcttccaggcgaaacctttcacatccagccgctggatctgcatcaaatgcaggaggccgttaaccagggaaccgtgcagtttgtgataaccaacccggcgcaatttgtccaactgaacagccatgcgccgctgcgctggttagcttccctgcgttccacgcgcgatgggaaagcggtgagcaatgttattggcagcgtgattttgacccggcgcgatagcggcatcaccacggcgcatgatctcatcggtaagacagtcggcgcgattgatgctcaggcgtttggcggctatttattaggctataaagcgctcagcgacgcgggcttacgcccggagcgcgattttcatcttcgttttaccggatttcctggcgatgccttaatctatatgctgcgcgaaaaagcggtgcaggcggcaattgtgccagtgtgcctgttagaaaatatggatcaggaaggattgattaataaaaaggactttatcgcgctgctttcccgaccgacgcccctgccttgcttaaccagtacgccgttatatcctgactggtcgttcgcggcgctacctgcggtaagcgatgcgctggcggatcgcgtaacgcgagcgctattcaacgcgcccgccgccgcgtcatttcactggggcgcgccagcgtcgaccagtcaggtggaagcgttgctgcgtgatgttcgtcagcaccctcagcagcgtcgactgtggctggatgtcaaaagttggttaatccagcaccagctaatggtcggcggcgtgattttggcgttcctgttgctcacgctcaattatatttgggtcatgctgctggtgcgtcgacgtggaaagcaactggaacgtaatagcgtagttcttcatcagcatgagcgggcgctggaaaccgcccggcaaatgagcgtgttgggtgaaatgacctccgggtttgcccatgagcttaatcagccgctttccgcgattcgacattatgcccaggggtgcctgattcgactgcgcgctgcagatgaacagcatcccttgctgccggcgctggagcagattgaccagcaggcgcaacgcggtgcggatactctgcgtaacctgcgtcactgggtcagccaggcgcagggcaacccggtgctaaccgaagcgtggaaggccatagccattcgcgaggcgattgatcatgtctggcaattgttgcgtatggcgcaacaatttccgacagtgactctgcataccgaggttagcgctgcgctgcgcgtaacgctgccgtcagtgctgctggaacaggtgctggcgaatatcattcttaatgcggctcaggcgggcgccacccatttatgggtcgttgctgaacgcactgaaaacggcatcagtattgttttacaggataacgccgggggaatcgacgaggcgctattacgtcaggcgtttcagccgtttatgaccacccgtaaagaggggatgggcttagggctggcgatttgccagcggctggtgcggtatgggcggggcgatatcagcatcaggaaccagaccgcgccggacggtctgtcgggaacggtggtcacgatacatttcttacatgaacatgggggcagggatggcgacaattcatctactggatgatgatacggcggtcactaacgcgtgcgcgtttttactggaaagtctgggatatgacgtaaaatgctggacgcagggggcggattttttggcgcaggccagtctgtatcaggccggggtcgtattactggatatgcgaatgccggtactggatgggcagggcgttcatgatgcgttgcgccagtgcggaagtaccctggcggttgtttttcttaccgggcatggcgatgtaccgatggccgtggagcagatgaaacgcggcgccgtcgattttctgcaaaaaccggtatcggtaaaaccgctacaggcggcgctggagcgtgcgctgacggtttcatcggcagcggtggcgcgccgtgagattatactgtgttaccagcagttgacgccgaaagagcgtgagctggccagcctggtggcaaaagggtttatgaaccgtgaaattgcggaagcgatgaatatcgcggtgcgtaccgtagaggtgcaccgcgccagagtcatggaaaaaatgcaggccggtagcctggcggaactgattaggcgtttcgaaaaaatggcctcgccagagaccagaatacgaacaacgtatgagccatgaataataaactgcgttatttctttgatttgcatcaaattttgtttaattgagaagactgttatattctgttggtttgagctggcgacgagtaaaacgtatgacaaaaccgacaaaagatgacgaactgtaccgcgagatgtgccgggtggtgggcaaggtcgtgctggaaatgcgcgatctggggcaggagcctaaatatattgttattgcgggcgtgttaagaaccgcgctggcgaatcaacgcatccaacgtagcgcgttagaaaaacaggctatggaaaccgtgattaacgctctggcgcggtcatagccgctatcagggtggcaataacgaaatcgcctttgaattgtcgcgattgtcaccatggcgggctggttacccgccgttagcgatgcgcagggttatcaggtgatggctaagcgcagccctaatgtatcagggtacggctcaaaataattctggctgcgtagatagtcatccggatgttccgccagatagtgcttcagcagcgttaacggtgccaggataggtagtcggcccgcccggtagccgagaatcacctcgcgtaattccgcgcgttgcctgctgttcaacgcgcggtgaaaatagccctggatatgcatcagcacattggtgtgatttttacgtgaagcggggtgtcgcaggatagccatcagtttttctctgtatcggacaaagaaggcatccagatcgtcccactcatgcagacgcgcgacgaaagggccaatttcgcggtagccggcctggtggtgggcgagaagctgaagtttgtatcggctatgaaacgcgagcaaactgtgacgactcaagccctgcgcgcgtagcgcatttaattcatgtagcgcgaagatacgtgcgatgaaattctcgcgtagtaccggatcgtgcaggcgaccatcttcctctatcggcagccagggatatttgtccatcatcgcggcggtaaacagccccgtgccagctttgcggcccctgttacccttttcatcatacaggcgaacgcgctccattccgcaactgggcgatttcgcacacacaataaaccccgccagttcgcctattgttggcagaaaccgatcggcaaaggcattcattcgctcggtgacgtcatcgtgcggggcatggctatagcgcatccgaatgtcgccacaggtcgtctggataagacgcagcgcagggcggggcacgggcaggccgatcgccacctccgggcagatcggtttgtaggccacccacggcgccagagagttcatgacaaaatccatacgcttatgtccgccatcaaagcgtaccgcggcgccagtcagacatccgctaatgccgactacgggtttgttattcatgattcccccttattgaaagtacgacgactgacgccaacggcgcaaaatgttatctcacgctgatttaaaacttacacaactttgtttttttgtctaagttttcgcggagatttttttgatgtacttaaatatcaataagatagaatgaggggaagaaatctatttcagcgcttatagtgtgataacctccagcgaagcgaccacgttgcgccactgggcaagctgttttttctgcccggcagtgagcttgccggtggtcaccaggaaccattttctctgggcgaacagctcgggcgccagaacggctggtggagagggaagcacattgagccgcagctcttgtccggtacgagtcaacgcttccagccagatttcacagtgatccgagagatgccatccgctaataaaagcattgttgccaggcgcttttctgtcgccttcaaggcaaaaagaggtgtaggcaataatgatgccatccaatatttcgcgcagcgtcatcacggcgggaagatgcgcggacactttgctgcgcaacggacgcaataaatgggtcaccagttctgcgcggggatattcccggccacagtcataaatcaactgccgcagcgcgtcaattcgcccttcgtggagatgttgaagcatcgtctcctgaatcgttatccagttatcgcccaggcgaatgaccggacgcgacagtaagggtttgacctgacttatcggtacgccttttctcacccagtcgaggatgctaagcgcttgtcgaatatcgtcatcgctgtataagcgatgcccgccatcagtacgctgcggtttcaataaaccatagcgtcgctgccatgcccttagcgtggcggcattgataccgcatagtctggcaaattcgccgatagaatacgacatggtaaagcccgttaaataaggggattctactatatcatgattaaatgaagactaaggtagtgataaatggtgcggcataccagggcatccgtatggattttgtcgatgatgagcaatactgcgtggcgtaaggctcatcaaaatatgaccaatgcttaataccatcggatgcccctggttaatactctattaacctcattcttcgggcgcagttaagtaactctgtcactttatgaacctgtagctttctcatcatattcatccgatgtgtttcgacggtttttatactgatatgtagcttttcgctgatcccatgattggtatacccctcgtcaataagtttaagaacctgacgctcgcgcaaagtaagcagttgatgattggtcgtgtcagcgtttaattcagccaggatagcttcccgattcaacgtcgggtcaatgtaacgcttgtttactgcgactgtttgcaatgccgctaacaggacttgctgactactgctttttaaaacatagccattagcacctgcggctaaagttttaatggtcatatactcttgttggtatgctgtgtaaaccagaatattcattgctggccaacgctgatgtaattgaggaatgatatccaggccattgatgccaggtaagctaagatcaaggataagtatgtcaggctcgtatgcgcaacaggcattataaacctcaagaccatttttaacatgctctacaattttaaaatgaggccagggtaataaggcattcataatgccgttaatgatgatttcatgatcgtctactaataagatcttatattctttcattttgctgccctcgcgaaaattaagataatattaagtaatggtgtagtttttgaagatcatacgtattttctggcgtaagtcggttagttcttccagcgcgatgattttccccatttttacgcgattctcaatgtctatgacatagcataccaattcagtctgccctatttgacctaaacagccttttaatgtgtgaattaactgatcgattttttttccagccgatacggcattttcaatatcagccagcaagaggtccagtgattggaaaatcttgctattaatgaccatatcatctgtcgccagtagcgctgagcagcgacttggatcctgctcctgtagctctatatttcgtaaaagttggtattctgcggcaatactgatatagcgagctaaggtagccaacgtcactggtttggtaatgtaatgatgaatcccattttttttacaacgatgaatatcttctgtcgctacgctagcggatagcgccacaaacatgcagtcaggatctaaattattcggctcatcgtgccataattgtacacattcaataccatctatttctggcattctaatgtcaatcagtactaaatcgaatcgttgctgttgtgataaagtcagagcctcgttactactggcggcaatagtgacgtgttggcccaggctgacaagcattttgccgatgatatcccgattaatatcggcatcatcaaccaaaagaatctgtaactgccagggtggtaacaaattatttattattggtatatttggtgtacacaatattaactgttgcgccaggtcgtagagttttccggggaaatacaaaagctcagcgttgagaagcgcattttgctggtggggtggttcgccgcgtattccccagcaagccagttggcgatgcaggcagaacggcgctgacagtgtccctttaatttgttgaggcggttggtattcttgtaagggtaatactagcgagacacaggttccaaccccggggacactttttagtgtcagattaccgcccatcattttagccaggcttgacgcaatagtcagtccaattcctgtaccttgcgaatttgtgtctgcttgataaaaagcagtaaagatttgagactgctgctgtatttcaatccctttaccgctatcgctaaccagaaatattaattgttcctcatgacgcttgaccgtcagacgtatccctccggtttcggtaaattttaccgcgttcccgagtaaattaaccaaaatttgccgtaaacggatactgtcggtatgaaaatagagggggacatgttgaccaacaaaagtacgtaatgacagttttttgctttgtgctggcccctggatggtttgcattgcctggtccagtaacggcagtaacgctgtttcttccatatgtaatgtgaaatgaccagactcgatgcgtgaaaaatccagcagattattaataatagctaacaaagacagtgtgcaatttctggcggtatcagctaatccttgctgctctatgtttaaaggggtggtttgtaataattcaattgcaccgagtacgccattcatcggagtacgtaactcatgacttattaccgtaagatgaatgcttttacgtttgttagcttgctcagcgcgtttttttgcttcatttagcgcctgggtgcgctctgcgactttgttttccagattgtcgtattggacttgtagggtatcaagtagttggttaaaagcaccggcaatactatctaattcatccagtcgttgtgctggtaaacgtgtgctcagcggtgcagttgcggttttattaatgatatcgacaaaacgccataacggtttggccagtgagcgatgtagtaaccagcaaaaagccgacgtcatcaacaccaatgctgttaatgtaaaggggatttgttggaggatagtttttaagatgcgattatgtagattaccgtatgggtacagcgtaaccagactccatccggggccatgcaaagttgtgcgtaatatcagaaatccgggaatttgttgccatccatcatgcagcgttacattttctaactgtgtacgtattttttgcgggatgtatgaaaacggcaataagtggttgttttgatccagccatactcgaatactatcatctaatggtaggtggctcttagaaatgagatcaggaagtttaaccatcaccccaaaaaatacgccttgctgatcggcaaccgcaacggaagcgtgccatcctttgccgtttatgtattctggttcactccagtaaaacccggcatgggttgggtataaaggaaagctttttcgcgttaaaagctgtagagttgaataatctgaagggttatcagtagataataacgaaatctcatttttatggttaagaataaaactatcgcgacgaaagcttttttcatcgatatcagaggactgcagaaagagacgatgcttctctccgtttagcgtcggcgtgcaatttgaaggaccgacagaaagatgccggctcacctcagggaaaatatcattatgatgaatctcagtcgctaatgagcattgatacattaaatttttagcgtcacgttcagcctcttcaaatcgttgattgcttagtacaatattcatctcggatagagcggataaatcctctattatatgctgccgtttctgaaccattgatatataagctgcagtaatcacagatagcagccaaataattatggttgttaataaaaataaaaaagttagcctgattactaaagatgtttgcagcgtattcttgagattgagcaaattcataatgctttcctccagttgcctgttgcaaaatctttggcacttgatcactatcgcagtacatatagtttcatcagaagattaatcgatggtgttatcattaggaagataaatttcttcatatataaaccagtcgatgactacaattactttttaataaggcagcgatgtaaaaacatcgtaacagtttatttaataaataatttttcaaattgtaagtttttgtgtctatgctgaaaatgtaattgtgaatttatcggaaaatccgaatgatagaatcgcctgtgacaaggtatatgtagacagcatcctgatattgtacaagaagagtatagtcgaaataaatgtgaatcaggctttttacggatgtggttgtgagcgaatttgatagaaactcccatttatgtctgaggagggattcatgctggcagttttaaaaggcattccattaattcaggatatcagggccgaaggtaatagccgatcctggataatgactattgatgggcatcctgccagaggagaaattttctcagaagcattttctatttctttgttcttaaatgacctggaaagcttacctaagccttgtcttgcctatgtgacactactgcttgcagcacacccggacgtccatgactatgctatacagctcacagcggatgggggatggttaaacggttattataccacaagtagtagctctgagcttattgctattgagatagaaaaacacctggctttaacttgcattttaaaaaatgtaatacgcaatcaccataaactttattcgggtggggtataaaatggtagtaaataaacgtttaatcttaattttactatttatactcaatacagcaaagagtgatgagttatcatggaaaggtaatgacttcaccctttatgccagacaaatgccattagcagaggttttacatctgctctcagagaactatgatacggctattactattagcccattgataacagctacatttagtggaaaaattccgcctggaccaccggtcgatattttgaataacctggcagcacaatatgatttgctaacctggtttgatggcagcatgttatatgtatatcctgcatcgttattaaaacatcaggttatcactttcaatattttatctactggacggttcattcattacttacgcagccagaatatcctttcatcaccgggatgcgaggttaaagaaattaccggtaccagagctgtggaggtgagtggtgttcccagctgtctgactcgtattagtcaattagcttcagtgctggataatgcgttaatcaaacgaaaagacagtgcggtgagtgtaagtatatacacgcttaagtatgccactgcgatggatacccaataccaatatcgcgatcagtccgtcgtggttccaggggtcgtgagtgtattgcgtgagatgagtaaaaccagcgtaccggcgtcatcgacgaccaatggttcacccgctacacaggcattgcccatgtttgctgccgacccacgccagaatgcagtgatcgttcgtgattatgcggccaatatggccgggtatcggaaactcatcacagaattagatcaacgccagcagatgatagagatttcggtgaaaattatcgatgttaatgctggagatattaaccagttaggcatcgactggggaacggcagtgtcgctgggtggcaagaaaattgcgttcaatacaggtttgaatgacggtggtgctagcggtttttcaacggtaatcagcgatacctcaaactttatggtgcgtttgaatgccctggaaaaaagctctcaggcttatgtactttcccagccatctgtggtgactttaaataatatccaggctgtgctggataaaaatattactttctataccaaactgcagggagaaaaagtggctaaacttgaatccatcactacgggttctttgttgcgcgttacacctcgcttgttaaatgacaatggcacgcaaaaaataatgcttaatcttaatattcaggatggacaacaaagtgatacgcaaagcgaaacagatccgctacccgaagtgcaaaattctgaaattgcttcgcaagccacattattggccggacaaagtctattgctgggagggtttaaacaaggtaaacaaatccactcgcaaaacaaaatccctttattgggcgatatccctgtcgtaggtcatttgtttcgcaatgatacgactcaagtacatagtgtaatcaggctttttttgattaaagcctcagtagtaaataatggcatatctcatggttaatccaaagagttcctggaaaatacgttttttaggtcacgttttacaaggccgggaagtatggctgaatgaaggtaacctgtcactgggggagaagggatgcgatatttgtattccgctggctataaatgaaaaaattattctgagagaacaggcagatagtttatttgttgatgccgggaaagccagagttagagttaatggccgcagatttaatccaaataagccgctaccatccagtggggttttgcaggttgcgggagtggctatcgcgtttggtaaacaggattgtgaacttgctgattatcaaatacccgtttccagatcagggtactggtggttggctggcgtattcttgattttcatcggtggaatgggtgtcctgttaagtattagtggtcagcctgaaacggtaaatgacttacctttgcgggttaagtttttattagacaaaagcaatattcattatgtgcgggcgcaatggaaagaagatggaagcctgcagttgtccggttattgctcgtcaagcgaacagatgcaaaaggtgagagcgactctcgaatcatggggggtcatgtatcgggatggtgtaatctgtgatgacttattgatacgagaagtgcaggatgttttgataaaaatgggttacccgcatgctgaagtatccagcgaagggccggggagcgtgttaattcatgatgatatacaaatggatcagcaatggcgtaaggttcaaccattacttgcagatattcccgggttattgcactggcagattagtcattctcatcagtctcagggggatgatattatttctgcgataatagagaacggtttagtggggcttgtcaatgttacgccaatgcggcgctcttttgttatcagtggtgtactggatgaatctcatcaacgcattttgcaagaaacgttagcagcattaaagaaaaaggaccccgctctttctttaatttatcaggatattgcgccttctcatgatgaaagcaagtatctgcctgcgccagtggctggctttgtacagagtcgccatggtaattacttattactgacgaataaagagcgtttacgtgtaggggcattgttacccaatgggggagaaattgtccatctgagtgccgatgtggtaacgattaaacataatgatactttgattaactatccattagattttaagtgagtggaaaatgacaactctgacccggttagaagatttgctgcttcattcgcgtgaagaggccaaaggcataattttacaattaagggctgcccggaaacagttagaagagaacaacggtaggttacaggatccgcagcaatatcagcaaaacaccttattgcttgaagcgatcgagcaggccgaaaatatcatcaacattatttattatcgttaccataacagcgcacttgtagtgagtgagcaagagtaaagtaaaaatatcttagagcctatcccaccaggcgttaattggcgcagccagtttggacacggatagcgcgcaaaaaccggagcgtacacgtagtacgtgaggattttgagcactgcccaggttcaaaatggcaagtaaaatagccctaatgggacaggctcttagttagcacgttaattatctatcgtgtatatggaggggaatgatgataaagaaaaaggctgcgtttagtgaatatcgtgatttagagcaaagttacatgcagctaaatcactgtcttaaaaaatttcaccaaatccgggctaaggtgagtcaacagcttgctgaaagggcagagagccccaaaaagagcagagagacagagagtattcttcataacctatttccacaaggcgttgccggggttaaccaggaggccgagaaggatttaaagaaaatagtaagtttgtttaaacaacttgaagtacgactgaaacaacttaatgctcaagccccggtggagataccgtcaggaaaaacaaaaaggtaaagcataatgtcttcaggaaacatcttatggggaagtcaaaaccctattgtgtttaaaaatagcttcggcgtcagcaacgctgataccgggagccaggatgacttatcccagcaaaatccgtttgccgaagggtatggtgttttgcttattctccttatggttattcaggctatcgcaaataataaatttattgaagtccagaagaacgctgaacgtgccagaaatacccaggaaaagtcaaatgagatggatgaggtgattgctaaagcagccaaaggggatgctaaaaccaaagaggaggtgcctgaggatgtaattaaatacatgcgtgataatggtattctcatcgatggtatgaccattgatgattatatggctaaatatggcgatcatgggaagctggataaaggtggcctacaggcgatcaaagcggctttggataatgacgccaaccggaataccgatcttatgagtcaagggcagataacaattcaaaaaatgtctcaggagcttaacgctgtccttacccaactgacggggcttatcagtaagtggggggaaatttccagtatgatagcgcagaaaacgtattcatgaaaaaagacccgaccctacaacaggcacatgacacgatgcgatttttccggcgtggcggctcgctgcgtatgttgttggatgacgatgttacacagccgcttaatactgtgtatcgctatgccatgcagcttatggaggtaaaagaattcgccggcgcagcgcgactttttcaattgctgacgatatatgatgcctggtcatttgactactggtttcggttaggggaatgctgccaggctcaaaaacattggggggaagcgatatacgcttatggacgcgcggcacaaattaagattgatgcgccgcaggcgccatgggccgcagcggaatgctatctcgcgtgtgataacgtctgttatgcaataaaagcgttaaaagccgtggtgcgtatttgcggcgaggtcagtgaacatcaaatcctccgactacgtgcagaaaagatgttacagcagctttctgacaggagctaaaaatgaatcgaattcacagtaatagcgatagcgccgcaggagtaaccgccttaacacatcatcacttaagcaatgtcagttgcgtttcctcgggttcgctgggaaagcgccagcatcgtgtgaattctacttttggcgatggcaacgccgcgtgtctgctatccgggaaaattagtcttcaggaggcaagcaatgcgttgaagcaactgcttgatgccgtacccggaaatcataagcgtccatcattgcctgactttttgcagaccaatcccgcggttttatcaatgatgatgacgtcattaatactcaacgtctttggtaataacgctcaatcgttatgccaacagcttgagcgggcaactgaggtgcaaaatgcattacgtaataagcaggtaaaggagtatcaggagcagatccagaaagcgatagagcaggaggataaagcgcgtaaagcgggtatttttggcgctatttttgactggattaccggcatatttgaaaccgtgattggcgccttaaaagttgtggaaggttttctgtccggtaatcccgcagaaatggctagcggcgtagcttatatggccgcaggttgtgcaggaatggttaaagccggagccgaaacggcaatgatgtgcggtgctgaccacgatacctgtcaggcgattattgacgtgacaagtaagattcaatttggttgtgaagccgtcgcgctggcactggatgttttccagattggccgtgcttttatggcgacgagaggtttatctggcgcagctgcaaaagtgcttgactccggttttggcgaggaaatggttgagcgtatggttggtgcaggggaagcagaaatagaggcgttggctgaaaagtttggcgaagaagtgagcgaaagtttttccaaacaatttgagccgcttgaacgtgaaatggtttcgccgggcgagatggaagaggagtctgccgaattttctcgtaacgtagaaaaaaatatgacaaaaaatgcgggaaaaagttttacgaaagagggggtgaaagccatggcaaaagaagcggtaaaagaagccctggaaaaatatgcgcaagaaggggaaaagtttctgttaaaaaattttcgtaataaagttctcttcaatatgttcaaaaaaatcctgtatgccttactgagggattgttcatttaaaggcttacaggctatcagatgtgcaaccgagggtgccaatcagatgaatactggcatggttaacacagaaaaagcgaagcttgaaaagaaaatagagcaattaataactcagcaacggtttctggatttcataatgcaacaaacggatgaccaaaaaaagatagaacaaaaacgcttagaggggctttataaaggtagcggtgccgcgcttagaggtgtattagataccattgatcactatagtagcgttcaggcgagaatagctggctggcgcgcttaatctgaggataaaaatatggaagcgagtaacgtagcactggtattaccagcgccttccttgttaacgccttcttccactccatctccctccggggagggaatgggtactgaatcaatgcttctgttatttgatgatatctggatgaagctaatggagcttgccaaaaagctgcgcgatatcatgcgcagctataacgtagaaaaacaacgactgtcctgggaactgcaagtcaatgttttgcagacgcaaatgaaaacaattgatgaagcgtttagagcatcaatgattactgcgggtggcgccatgttgtcgggagtgctgacgataggattaggggctgtaggcggggaaaccggtcttatagcgggtcaagccgtaggacacaccgctgggggagtcatgggcctggggtccggtgtagcgcaacgtcaaagtgatcaagataaagcgattgccgacctgcaacaaaatggggcacaatcttataataaatccctgacggacattatggagaaagcaactgaaattatgcagcaaatcatcggcgtggggtcgtcactggttacggttcttgctgaaatactccgggcattaacgaggtaaatatggtgcaagaaatagagcaatggttgcgtcggcatcaggtgtttactgagcctgcatatttaggggagaccgccatattacttgggcagcagtttatattatcgccttacctggtgatctatcgtattgaggcaaaagaaatgattatttgtgagttcaggcgcctgacgcccgggcaacctcgaccacagcaattgtttcacttactgggacttttacgcgggatatttgtgcatcacccgcagttaacatgtttaaagatgttgataatcaccgacgttctggatgaaaaaaaagctatgctacgcaggaaattattgcgcatcctgacagtaatgggagcgacctttacacagcttgatggcgataactggacaattttatccgccgagcatcttatccagcgacgtttttaaatgaccttcctggcgtaaatcattatcacgtgaaaataacaatcaataggtatgatgatgaaagaagatcagaaaaataaaatacccgaagacattctgaaacagctattatccgttgatccggaaaccgtttatgccagtggttacgcctcatggcaggagggggattattcgcgcgccgtaatcgattttagctggctggtgatggcccagccatggagttggcgtgcccatattgcattggctggcacctggatgatgcttaaagaatacacgacggccattaatttctatggacatgccttgatgctggatgccagccatccagaaccggtttaccaaacgggcgtctgtctcaaaatgatgggggaacccgggttggcgagagaggcttttcaaaccgcaatcaagatgagctatgcggatgcctcatggagtgagattcgccagaatgcgcaaaaaatggttgatactcttattgcttaaataacagaacgaaatatgaaaattcatattccgtcagcggcaagcaatatagtcgatggtaatagtcctccttccggtatacaagcgaaggaggcatcgtttcctccccctgaaattccagcccctggcacccctacagttcctgtggtgcttacgcctgaacaaataaggcagcagagggattatgctatacattttatgcaatacacgattcgtgcgctgggggcgacagtcgtgtttggattatcggttgctgcagcggtaatttctggcggagcaggattacccattgctattcttgcgggggcggcgctcgtgattgctattggggatgcttgctgtgcgtatcataattatcaattgatatgtcagcaaaaggcgccgttacaaaccgccagtgatagcgttgctcttgtggtcagtgcgctggccttaaaatgcggggcaagtcttaactgcgctaacacccttgctaattgtctttctttattaatacgttcaggaatcgctatttctatgttggttttacccctacagtttccactgcccgcggctgaaaatatagcggcctctttggacatggggagtgtaattacctccgttagcctgacggcgataggtgcggtactggattattgccttgcccgcccctctggcgacgatcaggaaaattctgttgatgaacttcatgccgatcccagtgtgttattggcggaacaaatggcattgctctgtcaatctgctactacacctgcattaatggacagttctggtcatacatctcggggagaaccatgaaacctgttagcccaaatgctcaggtcggagggcaacgtcctgttaacgcgcctgaggaatcacctccatgtccctcattgccacatccggaaaccaatatggagagtggtagaattggacctcaacaaggaaaagagcggttattggccggacttgcgaaacgagtgatagagtgttttccaaaagaaatttttagttggcaaacggtcattttgggcggacagattttatgctgttccgctggaatagcattaacagtgctaagtggtggaggcgcaccgctcgtagccctggcaggaattggccttgctattgccatcgcggatgtcgcctgtcttatctaccatcataaacatcatttgcctatggctcacgacagtataggcaatgccgttttttatattgctaattgtttcgccaatcaacgcaaaagtatggcgattgctaaagccgtctccctgggcggtagattagccttaaccgcgacggtagtgacgcattcatactggagtgggagtttgggactacagcctcacttattagagcatcttaatgatcttacctacggactaatgagttttactcgcttcggtatggatgggatggcaatgaccggtatgcaggtcagcagcccattatatcgtttgctggctcaggtgacgccagaacaacgtgcgccggagtaatcgttttcaggtatataccggatgttcattgctttctaaattttgctatgttgccagtatccttacgatgtatttattttaaggaaaagcattatggatattgcacaattagtggatatgctctcccacatggcgcaccaggcaggccaggccattaatgacaaaatgaatggtaatgatttgctcaacccagaatcgatgattaaagcgcaatttgccttacagcagtattctacatttattaattacgaaagttcactgatcaaaatgatcaaggatatgcttagtggaatcattgctaaaatctgaagttattagcgacgatgttcgacggttgctgctggaaatcatgtttgcgggcgttaaccatagcctgatttcccaggtacatgcgatgttaccagcgctaacggttattgttccggataaaaaattacagttggtatgtttggcattattgttggcgggtttaaatgagccgttaaaggccgcgaaaattttatcggatattgatttgccagaggctatggcgctacgaatgttatttcctgcaccaaatgaggggtttgaaaattgaatatttctgatatgagcatagtgcctgtaagcactcaatcttatgtaaagtcctttgcagaaccgagccaggagcaaattaatttttttaaacaattgctgaaagatgaagcatccaccagtaacgccagtgctttattaccgcaggttatgttgaccagacaaatggattatatgcagttaacggtaggcgtcgattatcttgccagaatatcaggcgcagcatcgcaagcgcttaataagctggatagcatgacatgaaggttcatcgtataatatttcttactgtccttacgttctttcttacggcatgtgatgtggatctttatcgctcattgccagaagatgaggcgaatcaaatgctggcattacttatgcagcatcatatcgatgcggaaaaaaaacaggaagaggacggtgttaccttacgtgtcgagcagtcgcagtttattaatgcggttgagctacttagacttaacggttatccgcatcggcagtttacaacggcggataagatgtttccggctaatcagttagtggtatcaccccaggaagaacagcagaagattaattttttaaaagaacaaagaattgaaggaatgctgagtcagatggagggcgtgattaatgcaaaagtgaccattgcgctaccgacttatgatgagggaagtaacgcttctccgagctcagttgccgtatttataaaatattcacctcaggtcaacatggaggcctttcgggtaaaaattaaggatttaatagagatgtcaatccctgggttgcaatacagtaagattagtatcttgatgcagcctgctgaattcagaatggtacctgacgtacccgcgagacaaacattctggattatggacgttatcaacgccaataaagggaaggtggtgaagtggttgatgaaatacccttatcagttgatgttatcgttgacaggactgttattaggagtgggcatcctgatcggctatttttgcctgagacgccgtttttgagccgacctgatcccgaagtgttgcaactttatcgttatttctggcaacctgctcgttacgctgtaccggaatggctggataagctgggctttcatctttcaaactgctggcgttatggcgatcggcccaaattggatcgtcttcttgacagagcgttaaatagactaaggggaagctctgttattccagcctgtttaaatgacaggcaaaaacgacagattcgtcttgcgccgcgtatatcggcatttgcctttggactgggattattcaaactcaggtgtagtgactattttatgctaccagagtatcggcaattgcttctacagtggtttagcgaggatgagatctggcagctatatggttggttggggcaaagagatggcaaattacttcctccgcaagtgatgcaacaaactgcattgcagatcggtaccgccattcttaatcgggaagcgcatgacgatgcggttttacatgcgctattagtattattaccccctccgcagcgtatactttggccgaagacttctcttaccgagattatcttcatggagcatttgctatgagttttacttcacttcctctgacggaaattaaccataagctacccgctcgaaatattattgagtcacagtggataacattacaattaactttatttgcacaagagcaacaagctaagagagtttcacatgctattgtgagctccgcttaccgtaaggctgaaaaaatcatccgagacgcctatcgttatcagcgtgaacagaaagttgagcagcaacaagaaatagcgtggttgcgtaaaaatacgctggaaaaaatggaagtagaatggctggaacaacatgtaaaacatttacaagaagatgaaaatcaatttcgttcattggtcgatcacgccgcgcatcatattaaaaatagtatagaacaggttctgttggcctggttcgaccaacagtcggtagacagtgttatgtgccatcgtctggcacgccaggccacggctatggcggaagagggagcgctttatttgcgtattcatcctgaaaaagaggcattgatgcgtgaaacttttggcaagcggtttacgctgattatcgagcctggtttctctcccgatcaggctgaactttcctcaacacgatatgccgttgagttttcactttctcgtcatttcaacgcgttactgaaatggttacgtaatggtgaagataaaagaggtagcgatgaatattaaaattaatgagataaaaatgacgccccctacagcatttacccctggcctggttatagaggaacaagaggttatttcgccttcaatgttagctctccatgagttacaggaaacggcgggggcagcgctctatgagacgatggaagaaataggaatggcgctgagtggtaaactgcgcgaaagtaataaattcactgatgctgagaaactggagcgcaggcagcaggctttgctgcgtttgataaaacaaatacaggaggataatggggcagcgttgcgtccgcttaccgaagagaatagtgatcctgatttacagaatgcgtatcaaattatcgctcttgcaatggcgcttactgccggcgggttgtcaaaaaagaaaaaacgcgatttgcaatcgcaactggatacgcttacagcggaggagggatgggaacttgccgtttttagtttactggaacttggcgaagtggataccgctacgctgtcctcgctgaagcgttttatgcaacaggcgatagacaacgatgaaatgcccttatcgcagtggttcagacgcgtggcagactggccggatcgcggtgaacgggtccgtattttgctaagagcaatagcctttgaacttagcatatgcatcgaaccctcggagcaaagtcgtttggccgcagcattagtacgcttgcgtcgtttgttgttattccttggccttgaaaaagagtgccagcgtgaggagtggatttgccagttgccgcctaatacattactgccgctactactcgatatcatttgtgagcgctggcttttcagcgattggttgcttgatagacttaccgctatagtttcttcatcgaagatgttcaatcggttactccaacaacttgatgcgcagtttatgctgatacccgataactgttttaacgacgaagatcaacgtgaacaaattctcgaaacgcttcgtgaagtaaagataaatcaggttttattctgatacctggctttcaatatttaggtaaattggctttctggctcatcatgaggcgtcaggatggattgggatctcattactgaacgtaatattcagctttttattcaattagcaggattagctgaacggcctttagcaaccaatatgttctggcggcaaggacaatatgaaacctgtctaaactatcataatggtcgtattcacttatgtcagatactcaagcaaaccttcttagacgaagaactgctttttaaagcgttggctaactggaaacccgcagcgttccagggtattcctcaacgattatttttgttgcgcgatgggcttgcaatgagttgttctccacctctttccagctccgccgagctctggttacgattacatcatcgacaaataaaatttctggagtcgcaatgcgttcatggttaggtgagggaatcagggcgcaacagtggctcagtgtatgcgcgggtcgtcaggatatggttctggcgacggtgttattaatcgctatcgtgatgatgctgttacctttgccgacctggatggttgatatcctgattactatcaaccttatgttttcagtgatcctgcttttaattgttatttatcttagtgaccctctcgatttatcggtatttccgtctttattacttattactacattatatcgtttgtcactcacaatcagcacatcacggctggtactgttacaacataatgccggtaatattgtggatgctttcggtaagtttgtcgtaggaggaaatctcaccgttgggttggtcgtatttaccatcattactattgtgcaatttattgtcattacaaaaggtatcgagagggtggcggaagttagcgcacgtttctcgcttgatgggatgccaggcaaacaaatgagtatcgatggcgatttgcgtgccggagttatcgatgcagaccatgcccgtacattaagacagcacgtccagcaggaaagccgttttctcggtgcgatggacggtgcaatgaaatttgttaaaggcgatacgattgccggtattattgttgttctggtgaacattatcggcggtattattatcgctatcgtacaatatgatatgtcgatgagtgaggctgttcacacttatagcgtactgtcaatcggagatggtttatgtgggcaaattccatcgctgctgatttcccttagcgcgggaattattgtcacccgtgttccgggtgagaaacgccagaacctggcgacagagttgagttctcaaattgccagacaacctcagtcgctcatattaaccgctgtggttttaatgctcctcgctttaattcctggctttccttttatcactctcgctttcttttcagcgttgttagcattgccaattatcctcattcgccgcaaaaagtctgtggtttccgcaaatggcatcgaagcgccggaaaaagatagtatggttcccggcgcatgtcctctaatcttacgtcttaccccgacgttacattctgccgacctgattcgtgatattgatgccatgagatggtttttatttgaggataccggcgtccctctccctgaggtgaatattgaggttttgcctgaacccaccgaaaaattgacggtactgctatatcaggaacccgtgtttagtttatctattcccgcccaggcggattatttattgataggcgcggacgctagtgtggtgggtgacagccagacgttaccgaacggaatggggcagatctgttggctttcaaaagacatggctcataaggcgcaaggttttggactggacgttttcgcgggcagccaacgtatctctgccttattaaaatgtgtcctgcttcggcatatgggagagtttattggtgttcaggaaacgcgttatctaatgaatgcgatggaaaaaaactactctgaactggtgaaagaacttcagcgccagttacccattaataaaatcgctgaaactttgcaacggcttgtatcagagcgggtttctattagagatttacgtcttatttttggcacattaattgactgggcgccacgcgaaaaagatgtcctgatgttgacagaatatgtccgtatcgcgcttcgccgtcatattctgcgtcgtcttaatccggaaggaaaaccgctgccgattttgcggatcggcgaaggtattgaaaacctcgtgcgtgaatccattcgccagacggcaatggggacctatactgcgctgtcgtctcgtcataagacgcagatcctgcaacttattgagcaggcgctgaagcagtcagccaaattattcattgtcacttctgtcgacacccgccgtttcttgcgaaaaattacagaagccaccttgttcgacgtaccgattttgtcatggcaggaattaggagaggagagccttatacaagtggtagaaagtattgaccttagcgaagaggagttggcggacaatgaagaatgaattgatgcaacgtctgaggctgaaatatccgccccccgatggttattgtcgatggggccgaattcaagatgtcagcgcaacgttgttaaatgcgtggttgcctggggtatttatgggagagttgtgctgtataaagcctggagaagaacttgctgaagtcgtggggattaatggcagcaaagctttgctatctccttttacgagtactatcgggcttcactgcgggcagcaagtgatggccttaaggcgacgccatcaggttcccgtgggcgaagcgttattagggcgagtcattgatggttttggtcgtccccttgatggctgcgaactgcccgacgtctgctggaaagactatgatgcaatgcctcctcccgcaatggttcgacagcctatcactcaaccattaatgacggggattcgcgctattgatagcgttgcgacctgtggtgaagggcaacgagtgggtattttttctgctcctggcgtggggaaaagcacgcttctggcgatgctgtgtaatgcgccagacgcagactgcaatgttctggtgttaattggtgaacgtggacgagaagtccgcgagttcatcgattttacactgtctgaagagacccgaaaacgttgtgtcattgttgtcgcaacctctgacagacccgccttagagcgcgtgagggcgctgtttgtggccaccacgatagcagaattttttcgcgataatggaaaacgagtcgtcttgcttgccgactcactgacgcgttatgccagggccgcacgggaaatcgctctggccgccggagagaccgcagtttctggagaatatccgccaggcgtatttagtgcattgccacgacttttagaacgtacaggaatgggggaaaaaggcagtattaccgcattttatacggtcctggtggaaggcgatgatatgaatgagccgttggcggatgaagtccgttcactgcttgacggacatattgtgctatcccggcggcttgcagagagggggcattatcctgccattgacgtgttggcaacgctcagccgcgtttttccagtcgttaccagccatgagcatcgtcaactggcggctatattgcgacggcgcctggcgctttaccaggaggttgaactgttaatacgcattggggaataccagcgaggagttgatactgataccgataaagccattgatacctatccggatatttgcacatttttgcgacaaagtaaggatgaagtatgcggacccgagctactcatagaaaaattacatcaaatactcaccgagtgatcatggaaactttgctggagataatcgcgcggcgtgaaaagcaattacgcagcaaacttaccgtgcttgatcagcagcaacaggcgattattactgaacagcagatttgccagacgcgcgctttagcagtgactaccagactgaaagaattaatgggctggcaaggtacgttatcttgtcatttattgttggataagaaacaacaaatggccggactattcactcaggcgcagagctttttgacgcaacggcagcagttagagaatcagtatcagcagcttgtctccaggcgaagcgaattacagaagaattttaatgcgcttatgaaaaagaaagaaaaaattactatggtattaagcgatgcgtattaccaaagttgagggaagtcttgggttgccatgccagtcttatcaggatgataacgaggcggaggcggaacgtatggactttgaacaactcatgcaccaggcattacccattggtgagaataatcctcctgcagcattgaataagaacgtggttttcacgcaacgttatcgtgttagtggcggttatcttgacggtgtagagtgtgaagtctgtgagtcaggagggctaatccagttaagaatcaatgtccctcatcatgaaatttaccgttcgatgaaagcgctaaagcagtggctggagtctcagttgctgcatatggggtatataatttccctggagatattctatgttaagaatagcgaatgaagagcgtccgtgggtggagatacttccaacacaaggcgctaccattggtgagctgacattgagtatgcaacaatatccagtacagcaagggacattatttaccataaattatcataatgagctgggtagggtgtggattgcagaacaatgctggcagcgctggtgtgaagggctaattggcaccgctaatcgatcggctattgagcctgaattgctatatggaatagctgaatgggggctggcgccgttattgcaagccagtgatgcaaccctctgtcagaacgagccgccaacatcctgcagtaatctaccacatcagctagcgttgcatattaaatggacagttgaagaacatgagttccatagcattatttttacatggccaacgggttttttgcgcaatatagtcggagagctttctgctgagcgtcaacagatttatcctgctcctcctgtggtagtccctgtatatttaggctggtgtcagcttacattaattgaacttgagtctatcgaaatcggcatgggcgttcggattcattgctttggcgacatcagactcggtttttttgctattcaactacctgggggtatttacgcgagggtgttgctgacagaggataacacgatgaaatttgacgaattagtccaggatatcgaaacgctacttgcgtcagggagcccgatgttaaagagtgatggaacgtcttcagtcgaacttgagcagataccacaacaggtgctctttgagattggacgtgcgagtctggaaattggacaattacgacaacttaaaacgggggacgttttgcctgtaggcggatgttttgcgccagaagtgacgataagagtaaatgaccgtattattgggcaaggtgagttgattgcctgtgggaatgaattcatggtacgtattacacgttggtatctttgcaaaaatacagcgtaaacctgataagaaaaataatatgcgaacaatataatagcgttccaggtcgtgtcatgagagatacagtatgtctttacccgattcgcctttgcaactgattggtatattgtttctgctttcaatactgcctctcattatcgtcatgggaacctctttccttaaactggcggtggtattttcgattttacgaaatgctctgggtattcaacaagttcctccaaatatcgcactgtatggcttcgcgcttgtactttccttattcattatggggccgacgctattagctgtaaaagagcgctggcatccggttcaggtcgctggcgctcctttctggacgtctgagtgggacagtaaagcattagcgccttatcgacagtttttgcaaaaaaactctgaagagaaggaagccaattattttcggaatttgataaaacgaacctggcctgaagacataaaaagaaagataaaacctgattctttgctcatattaattccggcatttacggtgagtcagttaacgcaggcatttcggattggattacttatttatcttccctttctggctattgacctgcttatttcaaatatactgctggctatggggatgatgatggtatcgccaatgaccatttcattaccgtttaagctgctaatatttttactggcaggcggttgggatctgacactggcgcaattggtacagagcttttcatgaatgattctgaattgacgcaatttataacgcaacttttatggatcgtcctttttacgtctatgccggtggtgttggtggcatcggtagttggtgtcatcgtaagtcttgtccaggccttgactcaaattcaggaccaaacgctacagttcatgattaaattattagcaattgcaataactttgatggtcagctacccatggcttagcggaatcctgttgaattatacccggcagataatgttacgaattggagagcatggttgaatgacacaacaggtaaatgagtggcttattgcattggctgtggcttttattcgaccattgagcctttctttattacttcctctattaaaaagtggcagtttaggggccgcgcttttacgtaatggcgtgcttatgtcacttacctttcccatattaccaatcatttaccagcagaagattatgatgcatattggtaaagattacagctggttagggttagtcaccggagaggtgattattggttttttaattgggttttgtgcggcggttcccttttgggccgttgatatggcggggtttctgcttgatactttacgtggcgcgacaatgggtacgatattcaattctacaatggaagctgaaacctcactttttggcttgcttttcagccagtttttgtgtgttattttctttataagcggcggcatggagtttatattaaacattctgtatgagtcataccaatatttaccgccagggcgtactttattatttgatcggcaatttttaaaatatatccaggcagagtggagaacgctttatcaattatgcatcagcttctctcttcctgccataatatgtatggtattagccgatctggctttaggtcttttaaatcggtcggcacaacaattgaatgtgtttttcttctcaatgccgctcaaaagtatattagttctactaacgctcctgatctcattcccttatgctcttcatcactatttggttgaaagcgataagttttatatttatctaaaagactggtttccatctgtatgagcgagaaaacagaacagcctacagaaaagaaattacgtgatggccgtaaggaagggcaggttgtcaaaagtattgaaataacatcattatttcagctgattgcgctttatttgtattttcatttctttactgaaaagatgattttgatactgattgagtcaataacgttcacattacaattagtaaataaaccattttcttatgcactaacgcaattgagtcatgctttaatagagtcactgacttctgcactgctgtttctgggcgctggggtaatagttgctactgtgggtagcgtgtttcttcaggtgggggtggttattgccagcaaggccattggttttaaaagcgagcatataaatccggtaagtaattttaagcagatattctctttacatagcgtagtagaattatgtaaatccagcctaaaagttatcatgttatctcttatctttgcctttttcttttattattatgccagtacttttcgggcgctaccgtactgtgggttagcctgtggcgtgcttgtggtttcttctttaataaaatggttatgggtaggggtgatggctttttatatcgtcgttggcatactggactattcttttcaatattataagattagaaaagatctaaaaatgagtaaagatgacgtaaaacaggagcataaagatctggagggcgatcctcaaatgaagacacggcgtcgggaaatgcagagtgaaatacaaagtgggagtttagctcaatctgttaaacaatctgttgcggtagtgcgtaatccaacgcatattgcggtttgtcttggctatcatcccaccgatatgccaataccacgcgtcctggaaaaaggcagtgatgctcaagctaactatattgttaacatcgctgaacgcaactgcatccccgttgttgaaaatgttgagctggcccgctcattattttttgaagtggaacgcggagataaaattcctgaaacgttatttgaacccgttgcagccttgttacgtatggtgatgaagatagattatgcgcattctaccgaaacaccataaatgcttttggtatgcttcttcaggccactgcgaaggttaagagggtaatagcgtatagagcagtgcttgacgataaaggtgagagactgaaaataatcgcttttagcctggcacaagcaccagatagcgtattataaaattaaacaagataatggattggtgcgtctgaatggactcgaaccatcgacccccaccatgtcaaggtggtgctctaaccaactgagctacagacgcattaaaatgatggtgcgttcaattggactcgaaccaacgacccccaccatgtcaaggtggtgctctaaccaactgagctatgaacgcaacgttgtaggtgacaacggggacgaatattagcgtcacaaccgcaatgaggcaagagggaaatcgcaattttcttcctgaaatcacctgattgcggtggaaatatgcaacatgtcgaaaaaatagccgccatgcgacggctatcgtcgtattatcgcgcagcgcgctgcaaaatgatggcggacggctgacgttgtagatagcgcatccgtagcatcattaacaccgccgccgaggtcaggccgatgatgaaccccatccagaagcctgccggtcccatacgatccaccaccaaatccgttaacgccaggatataaccgctgggtaaacctaacacccagtaggcggtaaaggtgataaaaaagatggaacgcgtatctttataaccgcgcagaataccgctgccgataacctgtatagagtcggaaatctggtaaaccgcagcgagcagcattaattgcgcggcaagcgccacgacctcagggttgtcattgtagagcaaagcaatatgcttacgcagagtaacggtaaaaatagcggtaaccacagccatacaaatgccgacgcctaaaccggtacgcgctgcggtttgcgcatccagcgttgagccctggcccagacgataacccactcgaatcgttaccgccgcagccagcgacatcggcagtacgaacatcagcgagctaaagttaagcgcaatctgatgaccggcgacatccacaatacctaatggcgaaaccagcagcgcaacgaccgcaaacaacgtcacttcaaagaacagcgccagcgcaatcggcaaccccagttgaatcaggcgcttcatgacgacgctatcaggtttgccaaagcctttttcattacgaatatcacgcattgaacgcgcgtgtttaatgtaagaaagcatggcgataaacatcacccaatagaccgccgcagtcgcaacgccgcagccgataccgccgagttccggcataccaaaatggccatagataaaaatatagttcaccggaatattcaccagcaggcccaaaaatcccatcaccatacccggtttggttttggccagaccttcgcactggtttcgcgctacctgaaagaaaaggtatcctggcgcgccccacagcagcgcgcgaagataacccacggctttatcggccagcgccggatcaatattatgcatagagcggataatgtatccggcattccacaggacgatcatcaccagcacggagacaaagcccgccagccagaacccttgtcgaacctgatgcgcgatacgctcacgacggccggagccattgagttgcgcaatcacaggcgtcaaggccagcagtaagccgtgaccaaacaaaatggcgggaagccagatagaggtgccgatagcgacggcagccatgtccgtagcgctatagcctcccgccatgacggtatcgacgaatcccattgcggtctgtgccacttgcgcaaggatcaccggtatcgctaacgctaataactgacgcgcttcactggtatacttctgcacgtattcaccttttattttgttgttatatgaaagactaaaaagccgccgtagtggcagccaaaagaaatagcaggggaaatttcagtctattgtagcggggtattactatttctccagtgaaaaaacagttgttaacggcgcattgctggcaagctgtttttccacctgctattgtgctgaacagttctgcgtttatttatttcaggagttgaagatatgtttacggggatcgtacagggtaccgcgaaactggtatcgattgatgaaaaacccaactttcgcacccatgtggtgacgttaccggactacatgctggaggggctggagacgggggcgtcggtagcgcataacggatgctgtttgacggtaactgaaataaacggcaatcagataagctttgatctgatgaaagaaacgttgcgcatcaccaatctgggcgcgttgagggtaggtgatgaggtcaacgtagagcgcgccgccaaattcagcgatgaaatcggtggacatctgatgtcggggcatattattacgacggcggagatcgcgaaaatcctgacctctgaaaataaccatcaggtgtggtttaaagtgcaggatgcgtccctgatgaagtatatcctgtacaagggctttatcggcgtcgacggcatcagtttgaccgtcggcgaggtaacgccaacgcgcttctgcgtgcatctcattccggaaacgctggaacgtactacgcttggcagaaaaaaactgggtgagcgtgtgaatatcgagatcgatccgcaaacgcaggcggttgtcgataccgtagaacgcgtactggctacacgagaaaatgtggtcagaaatcaggccgacattggctaacggaaaataagattcccccgcatgaaatgcgggggagatgattagcgaggaacgcgcagaccgttttcaacgccgcgcgtaaataccacctgccaaagctggatatcacgcgcgcgaaacgcacccgcgcaggcgttgagataatagctgaacatacgtttaaagcgctcgttataattgcccgcaatctctggccaggcattgataaagcgctcatgccacgccatcagagtcgtgtcatagtcggcgccaaagttatgccagtcttccattacaaagtgtgattcgctggcctcggcgatttgacgaacagacggcaagcaaccgttggggaaaatatacttattgatccacggatcgacattatgatcggtttttttagaaccaatagtatggagcaggaaaagaccatccggttttaaattcctgtcaacaacttcaaaataggtgttgtagttttttggcccgacatgttcgaacatgccgacggagacgattcggtcaaactgatcgttaaggtcgcgataatcttccaggagaatggagacatccagaccttcgcaacgcgtctgcgccattttttgttgttcagcggagatcgttacgcccaccacgctaacgccataatgggtcgccatatattgcgacaggccgccccagccgcagccgatatccagcacacgcatccccggttgtagctgtagcttttcgcaaattaatttcagcttggcttgctgtgccgcttccagcgtatcggcatctttccagtaggcgcaagaatattgcatatagggatcgagcatacgggaaaaaaggtcattaccaagatcgtaatgttccttgccgacaatccaggcgcgttttttactttgtagattaatcagacgcgcgccgaggatacggagcgtatctttgacatggtgggggagttgattttcaagaccggcacgtaagactttgctgaagaaaatatccagacgctcgcattcccaccagccatccatgtaactctcacctaaccccaacgatccttcctggaggacgcgtttaaaaaaatcgggattcttaacacgaatgtcagacggggcggaaccattaattgtaatatccgcacgacttaacaattcgttggcgattcggtaccagttatcatccggtacgctgacttcttctatacacgatgaactcatagtttctccatcactggacggtgatcagaaccttaaaacagcgtagacgcttttttggctttgtgagaaatcccacggacaattccgtgagccagttatccgacgtagaacagaggaagggaggagcccttgccgaaaaggccatccatggtgaatcgggaacactccggttcccgttaatgcctaataattatcgtaatataacaaccgggaatcagtataggccgcaatttttgatgattcaaccgaaaattgttagcgtgctaattaccagcggttaacaagtctttagtgagacttgtcgtgggcgacattggcatggggaaatccagtctcagcgcaatctgcatgagactgcattttgtaacctaacgccgccagaacaacggtagagagcattacgctggtggtggtcagcagcggcgtgctgatgagccatgaaaccaccaggcttgccaggaaacataaccccagttgcagcgtattttgtagcgccgcagcgcgccccgtggcttgagggaaagggcgtaacgcttgcgcgacgacgatagggtagattgcgccattagcaatcgccattacgcagaaaggaatcaggatctccaccagtgaggcattattcagaaggcccgctccccaggtggcgataacgctcagcgcatacagccctaacagccacggaagcaattggtagccctgccatttttgtagcgccgcgcggcaaccatatccgccaatcagaaaagcgatggtttgaggaacatagctcaggccaatcactgccgggctgtaacccatcgcgctgagaataaacggggaccctgttagccacgcaaaaaagctggcggaacaggcggcataaatcagcacattaccgcgataggttttagagcgtaacaacgtcgcgaaagtgagtttatcctgtccttcggtacgcgcttttaccgatggttttaagcgcagcgccggcaacatcagcaacaacgtaatcacgaacagggtggcgaaaatcacctgccatgagaaatgcgtcagtatccagcttcccagtaagggcgcaagcgccggggataatcccaccagtggcatgatcgtggcgaagatacggttaattttttgcgaaggataataatcggtcaccagcgcttgccagattaccgttgccgcacaaacgccgacggcctgcacaaagcgcagcgtcagcagtgctgccgcgctttctacccacagcatccccagacttccgagtgcaaagatagataaccccagcagtaaaatcggtttacggccataacgatccgatagcggtccccaaagtagttgcgcgacggcaaagccagctaaaaacaggcttaggctggcgctgacagcggcggcaggcgtttgtaaatccgcctgtatggcggcaaacgcgggcaggtacatgtccgtagccagaaatcccagcacgctaaggccggctaaccagactaaaaaaccttttccaggttgcatatttgtttctctttcttatcagacagacattgtcgcagagtgtagggagtgaaattacggttgtgaaacgttaatatttgtccagtgaattcaaaatttttgtaggcaaattatgtggtcggaatactcgcttgaagtggttgacgccgtggcgcgcaatggcagttttagcgcggcggcgcaagaactgcaccgtgtgccttcagcagtcagttacaccgttcgtcagttagaggagtggctggccgtaccgctttttgtacgacgtcaccgtgatgttgaactaacgcctgctggcgtctggtttttaaaagaagggcgttctgttatcaaaaaaatgcagatcactcgccaacagtgtcagcaaattgctaatggctggcgcgggcagttagctattgcggtggacaatatcgtcagaccagaacgtacccggcagatgatcgtcgatttttatcgtcattttgacgatgtggaactgctggtttttcaggaggtgtttaacggcgtctgggacgcgctctccgacgggcgtgtcgaactggcgattggggcgacgcaggcgattccggtaggggggcgttacgcttttcgggatatggggaccctgagctggagctgcgtagtggcaagcgatcacccgctggcgtcgatgcctgggccgttaagcgatgataccctgcgcaactggccgtcgctggtcagggaagacacttcgcgaaccttaccgaaacggattacctggttgctggataaccaaaaaagggtcgtcgtaccggactgggagtcatcggcaacctgcctgtcggcaggactatgcgtgggaatggtgccgacgcattttgcccgacagtggatagacagcggaaaatgggtggcgctgacgttagagaatccgtttcccgatgcggcctgttgcgtgacgtggcagcaaaacgaggcctcgcccgcgctggcatggctgctggactatttgggcgatagcgaaacgttgaatcgggagtggctgcgggagccagaagaggctcccgacagcggggattaacgccgatagtcgcggaacgggccgtcagcgaccgagcgacgctcaaccaggcgtggatgaacttcaatagactgtgactcttcacgcttattgacgatgcgatccaatagcatattaaatgcggtttcgcctaaagagtctttgggctggtgaatcgtcgtcagcgccggggtaaagaaacgggcgttacgcacattgtcataaccgatcaccgaaacgtcctgcggtacgcgaagccccatttcgtcagctgcgcaaagcgcgcccatcgccataatatcgccgccgcagaaaacggcggtagggcgatgtgactgcgataagatttgctgcatcgcgtggtaaccggattccggctcgaagtcgccctgaacaatccagttgtccggcacgttgatcagcgcctcctccatggctttcataaagcctgccagccgccccgcgcctgtgttgcgctccagcgggccgggaataacgccgatatcccggtggccgcgctcaaccagataacgacccgccatatagccgcctgcaaaggcgttatcaatcaccgtgtcggtaaaatcggccttcgcctcaccccagtccatcaccaccatcggaatatggcgatactcttccagcatggaaagcagaggttctggatactcagaacacatcaccagcaggccatccacgcgcttttgcgccatcatggacaggtaggcgcgctgtttttccaggttattccaggcgttgcctaaaatcagcgtatagcctttctggaaacagtttttttcaactgcctcgataatttcggcaaaataggccgcttcgctgctggtcgccagtaagcctatcgacttggtatggttaaccttcaggctacgcgcgacggcgctgggagagtagtgcagctctttaattgccgcccagaccgcgttacgcgtttcttcagcgacaaaacgcgttttgttgattacgtgtgatacagttgtagtggaaacgtttgcccgtttcgctacatctttaattgttgccattacatttcactccagaccctcgctaagctcctgagaaacgccaggtaaacgtttgcctacacacaccctaatcgcaacatcagggttgcggcacgccggaaaaacgacacggaacgtcaggaaggggtcaatggccgttacgctaattcagtaagcctggaattttgtctgatcttgaggaaaaggggaagcgttaaaaacagttatcaatataaaacatgagagatttttgtgcgggaatgtgcaaaaatgcgctatatcactttttgtgtgggaataaaaaggagaaaacttgatgagtaccgacctgaaattttcgttgattactacgctgattgttctgggcgtgattgtcgcaggtggattaacggccgctctgcactgatttcctctcttctgagagtgggcgtctcctctattctatccctctctaaaacgcagaaggcgtaccttctgcgtactcagacttatgcggcgagatttttcgcaacaaattcccagttaaccagcgcccagaaatgctccagatagtttggacgggcgttgcggtagtcgatgtaatacgcgtgttcccacacatcaaccgtcagcaacggcgttgcatccgtagtcagcggcgtaccggcatttgaggtagaaacgatagccagtttgccatcagcgctttttaccagccatgtccatccggaaccaaagtttttgatagcggcatcggtgaactgcgctttaaattccgcgaagctgccaaaagatgccgcgatagcatcagccagtttcccggtcggttcgccgccagcgtttggcgccaggcagttccagtagaaggtgtggttccacacctgagcggcgttattaaagatgccgccttcggaagtgcgcacgatctcttccagcgatttgccttcaaacgccgtgcctttgatcaaattgttaagattggtcacgtaagtctgatgatgtttgccatagtgatattccagcgtctcagcagaaatatgcggcgccagagcatctttggcatacggtaatgcaggtaattcgaacgacattgcttctctccttattattaatattgcgcacgcacaataaccctggtgcgcgtaaggatagggtagcaaattgagaggtggcgcaaaagaagaagttatcctgtcgttaaacgacaggataaaatattagcgaattgttttaggcgtcatcacccggcgggcgccgacataatgacgctgccagtactcttcgttcagtgaggtgatcttaatttcctgaccgctgcgcggagactggataaacttaccgttgccgacatagacgccaacgtgatcagcggtgccgcgcccctgtgtacggaagaacaccagatcgccgtttttcaactcgctacgctcaatgggggccgcgtcacgcaggtgatacatctcattcgccgttcgggggatacggatcttcactaaatctttataggcataataaaccagaccgctgcaatcaaaaccggtgcgcggcgatgcgcctccccagtgatacggtttaccaatctgattcatgagcttggacatcgcggttttcgtcgccttttgtacttttgcacgatgcgcatcggcaatagagaccggcaatgttcctttccccttcacgcagtgcggcttacggcctttacgcgtcgtgcatttttccgttacgtcgagggcggcgattgacgtgggcgcggttctgttacgacgatgcgtcgtatgacgagattttgtggcggcggtggtacgttttggcgtagaagcggaagaagaacggctggtttttgaggttttttttacgttttttttgctggttttactgatctttttagttgtgcttttctttttatctgccgttttcgtgacatgagaaacagcaggcgtcgctttggcttgcctggaagcatgggccattggcgtaaaggggagagtagtaaaaagtaaagcacagagcgtgatcgagattttgtttatccgcgccactgagcaatcctctgttaaaggcaggcgattcatgcctgcgtatgatttacaaaacctgataattctaatctacaaaagcacagattggtaattgcttttggtttctgaagctatgtttcgttaacagatgtaaaaaaatagcaattaatgctaaacacgaacgcgttatctacaaatcactgcgcggcaacccgcttaaaagatattttgtatacaacttattcccgcagacggtaaaataataaggcatgatgaaaatgttattttccgttgccagcctgacccgttacaatgacaggcttcggtcgtaaaagtagtttaaggaagcgagacaatgagcaccactatcgaaaaaattcagcgccagatcgctgaaaacccgattctcctgtatatgaaaggttcaccgaaactgccaagctgtggtttctctgcgcaagccgttcaggcgctttcagcctgcggggaacgttttgcctatgttgatatcctgcaaaacccggatattcgcgctgaattaccgaaatacgccaactggccgacattcccacaactgtgggtggacggcgagctggtcggcgggtgtgatattgtgattgaaatgtatcagcgtggcgagctgcagcagcttattaaagaaactgcggcaaaatataaaactcaggagccggacgcagagtaatctgtgaaaggggaaagcgacctgtaaaggtcgcttttttaccgccatcgtgagcaagagcggcgttgttagcctcgttatttgtccgtcggcaaaggtaacggccagccgcccaggcgcttccagcgattgacgatttcacaaaacagcaccgctgtccgctcggtatcatacaaagcggaatgggctttttcaccgtcaaactccatacctgccgccaggcacgcttttgataacaccgtttgtcccagcgccagtccgctcaatgccgcagtatcaaaggtgacgaacggatgaaacgggttacgtttcagcgaggcgcgctctgcggcggccatcataaaactgtgatcaaaagtggcgttatgcgcgaccataatggcgcggctacaaccgctgtctttgatacctttacgtaccattttgaaaatagcgtgtagcgcctcatattcactcaccgcgccgcgtagcgggttagagggatcgataccgttaaacgcaagcgcttccggctgtaagttggctccagcgaacggctctacatggaaatgcagcgtcatgtccggcatcaaccagccttgttcatccattttcagcgtgatggcggcgatttcgagcagcgcatcggttttagcgttaaatcctgcagtttcaacgtcgatgacgacaggataaaaaccacgaaaacggtcgcacagaccggaaagttgagcgttatcggacatctgagtctcttaatacgaaaaaatgcagcgcgtattatggcaaattttacgccgggatgcagtaaaacaacgggcgcagtgacctgcgcccggcgggggatcagttacccagaccgcggcctgcgtctttagcttcaatcaattcgattttatagccatccggatcttcaacgaaggcgatgatggtcgaaccgccttttaccggccccgcttcacgggtcacgttgccgccgttctgacgaatgcgttcacaggcttcagcagcattgtcaacgctcagcgcgatgtgcccatacgcattgcccatgtcgtagctctcaacgccccagttataggttagttcgatgaccgcttcttccgtttccggaccatatcccacaaaggccagcgagtatttgtattccggattctcactggtacgcagcaatttcatgcccagaacgttagtgtaaaaagcgatggaacgctgcaaatcgccgacgcgcagcatagtatgcaataaacgcattttcgttgtccttaaaatagtcaagatattcaaagtatagcggcgatgtgaggccgctatcaatgaaattacagagtagggtagtcagtgtagccttccgcgccgccgccataaaaactttcgggacgctgtggattaagttccgctttacgttgcagacgcgccaccagatccgggttagcgatgtaatcgcgaccaaacgccacggcgtcaatcagccctttttcgatcagatcttccgctttttctggcgtataggcgccagcgccgatgatgggaccgtggaaacgcgcgcgcactttttcacggaacgcgtcgctgtacggttcgccgcccgcccagtctggttcagacatatgcagataagcgatgccgcgtttgcctaacgcttcaatcagataaagggcgtcagcttcttcattcgggccgttatcgacattctggaaagtgccgacaggagaaaggcggatgccgatacggtccgcgccccattccttaatgccggcatcaaccacctccagcaccagacgggcgcgattctctacgctgccgccgtaccgatcggtacggtgattagaagacggtgagaggaactggtgcagcagataaccgtgcgcggagtgcagctccaccagatcgaagcctgcctctcgggcattggcgatagcctggcggaaatcgttgacgatcccggggatctcatgagtatccagcgcgcgcggcgtggaagtttctacgcggatggcctggccgttttcgtcacgcaaagaggtgcgggttcccgcattgatagcggatggcgcgacgggcgcttgtccgcctggttgcaggctggcgtgtgaaatacggcccgtatgccacagttgcaccgccatatggccgccctgggcatggactccctgagtgatttttttccaggcggcgatctgctcatcgctgtgtaatcccggtgcgccggcatagcctttcgcctgcgcggagatttgtgtggcttcgctgatgatcaatccggcgctggcgcgttgacggtaatattccgccattaacggcgtaggaatgtcgcccggttcaatactccgcaaacgcgtcaaaggcgccataaatacgcgatttgtcgccgtgatggcacccaccttgaggggggtaaacagttttgctgatgacatagtggctcctgatataagtagaccggtcgtcttgtaataaaggaaataaaaacgcccgttactgctcaggcgttgcaatgatggtcttaacatgcgccaacgcattttccagcggcgcggcgctacgggatattttggcctgcaaattggcgcccagccacagggcataaagtacctgcgcctgtggcaacggctggccggtgaaatgtaaacagtggctattacggccatcttccagcgcgcgtgcaagcagtgccatgatctcctgcgcccctttatccatcgtagagcgcatatcctccgacagatcgcagacttccgctgacagtttcaccgtcaggcaaccgctgatggcgccttgctggcaaaactgctttaacgtttcctgataccaggcgagaagacgatcgcgatgattaccgggaccggaggtgaagtgcgccgtaagacgctgatgatagcaggcgtaatgtcgctcaagcatggcgacgccgaaggcttctttcgagcgaaagtagtgataaaacgaccctttaggtacctgggcggttttgagcaactcgctaagccccatgccggtaaaaccccgttgcatacaaagctgctcgccggtggccagcagatgttcgcgggtatcatgttcggtttgcttattcatgacaggcagtatagtagaccagtcggtctactgcaagcagagttgccataatgtcagttagcgtcttcaatagtcataagcgccaaacgttgaggaggggatgtggccgagcagttggagttttttcctgtagcaagcccatgtcgcggtatctgccagtctgatgagcgtggcttttgtcggggatgtatgcgcagccgcgacgaacggtttaactggcaaaaaatgagcgatgccgagaaacaaaatgtactgcggctttgtcgccagcgtttcttgcgtaaaatacgcgcaaataagcctctcccatcggaagatcctcaacaaccttcactcttttaaacgcggaattgcgtatactcaacctcattattctctatgaggaatctgttatggttcagcgtgtcaccatcgctccacaaggcccggaattttcgcgttttgtcatgggttactggcgtttgatggactggaatatgtccgcgcgtcagttagtgagttttatcgaagaacatctggatttgggcgtcactaccgttgaccatgcggacatttatggcggttatcagtgcgaagcggcgtttggcgaggcgctaacgctggcgccgcatttgcgggaaaaactgcaaatcgttaccaaatgtggtattgcgaccaccgccagagcggaaaataggctcggtcattatattaccgatcgccgccatattattctgagcgccgaacagtcattaaaagatctggcgacagattatctggatatgttgttaattcaccgtcccgatccgttaatggatgcggatgacgtcgccgaggcgtttcaacatctacatcaaagcggcaaagtgcgccattttggcgtttctaattttacgccagcgcaatttacgttgctgcaatcgcgcctgccgttcaccctggcgaccaaccaggtggagatctcgccggttcaccagcctttgttgctggacggcacattagatcaattacagcaactgcgtattcgtccgatggcctggtcatgtcttggcggcggtcgtctgtttaatgatgaggcttatcagccgttgcgccaggaactttccgttatcgcgcaagaactcaacgctagttctattgaacaggtggtctatgcctggattttacgtttgccgtcgcagccgctgccgattattggctcgggtaaaatcgaacgcgtacgcgccgcactagaagcggaaacgctgtcattgtcgcgtcaacagtggttccgaatccgcaaggcggcactgggttatgacgtgccgtaatcgccaactcgttgactttccgttcatgttttcgccagtggtttacacttaacaggcgaccacatgtaacggaggttttatgaagcgattaagtttagcgatggtgacgctgctggcctgtgcgggtgcgcaggctgccagcgagaaagtagagatgaatctggtgacggcgcaaggcgtaggacagtctatcggcaccgtcgtcatcgatgaaaccgaaggcggcttaaaatttaccccacaccttaaagcgttgccgccgggcgagcatggttttcacattcatgccaaaggtagctgccagcccgcgattaaagacggcaaagcggttgccgcagaagccgctggtggtcatctggacccacaaaataccggtaagcatgaaggaccggaaggtcaggggcatctgggcgacctcccggtgttagtcgttaataatgatggtatcgccaccgaaccggttactgcgccgcgtctgaagtctcttgatgaagtgaaagataaagcgctcatgatccatgtgggcggcgataacatgtccgatcagccgaaaccgctcggcggcggcggaacgcgttacgcctgcggcgtcattaaataacccggagacagtgttccctgcgctggagcctgttccagctgcgacagcgaacagtgtaaacgccagataatcgccgccagctcatgcgcggcgggttgatgatgatgtgcgagcgtgtcgcagatacgctgtagttcctgtagcgtgacggcaagcgggcgttgctgcacgtcgcgctcgctcatcacatcgcgcagcagggatatacaaatatcccgcacccgggaaagcggatcggaacgcgactcccaggcgcgcagctgccacaccacatgcgagcagttcagcagcaccactccccaacgtaataaccaccggcgcgccagcgcatcctgactattgctgagctgactgacgtgatgataggtcagcgattcaaactcgctttcgctatgggaagggtgacggctaagctgatcgacgaaatcccggcgtagcgcgcggatatggcggcggctttttacggcatcggaaccggggcgcaaaatcgcaaacgccagccaggaaatcgcgacgccgacgatcttggcggtattatcgttaaggaagtcggcgaagtcgtacaccggtggattggtcacggcgatgaatgagcccataaaaacgataagctgcccccacagtcccgccagcttaggcatctgcagtttaagcagttgcatcgtgacgaacagcggaaaaaggaaaagcaagaattgccacagatcggtgatttgcaccatcaggccaaatttcaccacgaagctgaataaggacagcagcactaaagtacgcatcaataaggaaagcgacttaaacggcgtggcgacgatggagtagaggacgcaactgatcgccgccagggttaatgcgccgggcccggattcccattgcacgccaatactccaggcgccaatcaccgtgagcgtgcaaaaggtacgcacgccgctccagatggcctctgcgttatccgtatgccgcgcaaggccgggagtgcggcggatatggatttgatccaccggcgcgccgctttcgatcagatataattgacggctgctgcgcagatatagctggcaaaaatagcgtaatcgctgccagaacgcgaggtgacgataatcctgttcatcctgcgggcatagcggcgcaataatccgcgccacggtgtagctgtccgcgcgcggttttgccaactcagctaagagttgttcaatgacttcgcggctgttttccggcggcgtcggccagtttaaaagcattctacgcagactggagatcacgctggttagccgtaattgctggtgtaacaatgcatttagcaatgcattctgacggcgaaaacggtagtgactccagaaggcctgaatacgcagcaggttcatggtcaggatttgcccaatgaccccctcatgcgcggagcggatagcgtcggtagtctccggctgccacagtagactggcatgttccagcaagcgcgcatgcatgtttttcaacgcggtgagcagggcagtgccatccgatgtgctgggtaggatcatcatcatcatgccgccacagaggatgccgacgataacttcacatacacgtgcctgggcgatatcccacaactgcgtgatttctacaatattaaccatcgggaacgcgatgatcgccgccgtgtagccggacaactggaaagcataagcggcattattggtaaaatgcgcgcaggcccaggtacaaaaaccgatccaggcggccatgctaaataagaacaaccagggttcattcagcgtatggccggcaataatcaacgcggcggtcgcgccgagtaaactcccggcaatacgccccagacttttactgattacgccgcctacggtcggaaagctcaccactgcggccgaagtcatcgcccagtagggctcatccagattgagataataagcgaatgtcagcgcgagacacatggcaatggtattgcgcaacgcgtaacgccactggccggaggtcgctttaaaccagggcgtatttcgcagggccggcagggagagtttcattaccgctgtccaatggctacgctgcaggtagtgccggagacgagcgtgatatcctgcggcaaagcgtcaaattcgatacgtaccggtacgcgttgcgccagacgtacccacggtacgttgggtttgatatcgggcactaaaccggagtcactttccacgctttggtcgtaaatagcgcgcccgatactgccaacgtgaccctgtaacttaacattgccactatacagtgttattaatgcaggctcaccttcgcggatatggcgtagtttggtttcttcgaaatatcccattacataaaatgaatggctatctaccagggcgaaaagtggcttaccggtgctagcataatcaccggtacgcgtggaaaggttggtcacccagccggataccggcgcttttacttccgtctggctaagctgccactgcgcctgttttaacgttgccagtgcgacatctacgctggcctgcatcgctttaacattcagattggcgctatccagatcttcagcagagatgtagttacgcgataaatgtcgacgtcgatcggcttcattattcgcttttgccagatcggactgcgctttggccaactgtgcctgcgcgttaagttctgcaatatggaagggcgttttatcaatgacaaagagaacgtccccagcgttgacgaactgattatctttgatattgagttgggtaatgctgccagaaacctgtggcgttacgctgacctgttccgcgcggattttaccatcgcgcgtccacggtgactgcatatagtaattccataaccaccacgcggccagaacggcgacgacggcgacaatgagagtagaaaaatattttattgtttttaacgacatatttaccacacgatcagtaaaacgaggcccagacatacgcaaagcgtaaagagggagagatccattaacaggggatgccagatttcatcagagtatatccggtcacgcaggagtcggtgaataaacaaccagataacgaacccaagcgcaaaggctttgaagaatggcggaaagtaaacagatgctcccaacatgagatcttgtaagggcaatcctgtggcgttgagtatacacttcacaagcaatgttcctttgcgtcagacatcgatgctttagttttagccaaaaccgaagctacaggtgccaggtgcgcactatgtctgaaaaaatgtctattggtaagcaaatttagcaatacatttgttttgagaatacaaatactgcacactattctaaaatcagcataataacttagcaagctaattataaggaggtgaaattggaatcgccactaggttctgatctggcacggttggtgcgcatttggcgtgctctgattgaccatcgcctcaagcctctggaattgacgcagacacattgggtcacgttgcacaatattcatcaattgccgcctgaccagtcgcagattcaattggctaaagcgataggcattgagcagccatcgctggtacgcacgttggatcaacttgaagataaggggctaatttcgcggcaaacctgcgccagcgatcgtcgcgctaagcggattaaactgaccgaaaaagcggagccgctgatcgctgagatggaagaggtcattcataaaacgcgcggtgaaattttggctgggatttcttcagaggagattgagcttctgattaaacttgtcgctaaacttgaacacaacattatggaattgcactctcacgattgaggtgcaggggcatacgtgtggccatgtgaccacacgtaaagcctggtttagcgtggagagacagtaacctggctgccgttgctggccagcacgacacgctgacctgccgagaaacgcgtatttccttgtttctgcacaaccataatggtgttgccatcgtctttacgaatttccagttccacaccctgggttttattcattgcgctctggacgccctggcccgctacgccaccagccaccgcgcctgccgcggtcgccagtgaacgacccgtaccgccgccgatagtgttgccgaggaatccgcccaacaccgcgccgccgatagcgccaatcacgttagaatcatcaccgccctgaatttgaaccggacgaacgttaacgatagtaccgtacgttacattctgaacttgtttagcctcggatgcggtataaacatcacccgaaaggctatcattgttaacacacccagctaaggataaccccatcagtgaaacggccagtacacgtttaatcatttacccatctcctgttcttcacgaaacgctatttcagcatccctatagctaaattatatggcatttatgcagttaaggtcatatcttctgccgaaagaatgtaaaaatcataatcagaagttaattaactaatcttaaacgaagtgggaagcaagaaaagataggttattgatatccgtggacggcacggcaaaaaacgtgacgcgggcatcgcattgcaaaatacgttatgccgagtgttaaggcttaacccagcttaataaggaagaggtatgaaatcgggccgttttattggcgttatgtccgggaccagccttgatggtgtggatgttgtactggcggcaattgatgaaaccatggttgcgcaacaggcaagtctcacctggcccattcccgttcatctgaaaaaaggcattctcgatatttgccagggacaaccgcttacgctctcgcaactcggccagctggatacccagttaggccggctttttgcacaggcggttaatgcgctgttagcgcaacaacgtttgcagccgcgggatatcgtcgccattggttgtcatgggcaaacggtctggcatgagccgaccggcgaggccccgcatacgctgcaaattggcgataataatcacatcgtcgcccatacggggattacagtggtcggcgattttcggcggcgggatattgcgctgggcggacaaggcgcgccgctggtgcccgctttccatcacgcgctgttgggacatccgacggaaaaacgtatggtcctgaatatcggcggcatcgccaatttatctctgcttttccccggacaggcggtgcgcgggtacgacacggggccgggtaatatgttgatggatgcgtggatttggcgacaatgcgcgcagccctacgacaaagacgcggcatgggcgaaagaaggtcaggttattcttccattgctgcaaaagatgttgcgcgatccgtactttgctgcgtcggcgcccaaaagtacaggacgcgaatatttcaactatggctggttagagcgtcatcttacggctttccctggcgcagacgcgcgcgatgtacaggccacgctggcggagctgacggcggtctccatcgcccaacaggtgctgctcaatggcggctgcgagcggctgatggtctgtggcggcggaagccggaatccgttagtgatggcccgtctggcggcgctgttgcccggtatcgaggtttcgaccaccgataaggcggggatcagcggcgatgatatggaagcgctggcctttgcatggcttgcctggcgaacgctcgcgggcctgccgggaaatttaccttccgtgacgggggctacagaagccagtgttttaggcgctatttacccggctaacccaataactcagagttaactgaatttttcccggaccctatatcggtaaactagcaaggtcaggaaggggcgtttgcccttccagaagcaggagagctttcgggatatgcctatgaaaaagatcgcaataatgtttttacctgtgctgctgaccggctgtagcgtttatcaacaatttgttgaacgtatgcaaacggatacgctggaatatcagtgtgatgagaagccgcttaccgttaaagccaataacccgcgtgaagaggtcagttttgtttatgacaataagctgctgaccctgaagcaaggaatctcggcctcgggcgcgcgttataccgacgggatttatgttttctggtcgtaaggcgagagcgccacggtctataaacgagacagaattgtgcttaataactgtcagttacaaaatccgaagcgttgagattttcagtatgggggcgcacaatagcgccacccactgattatttctgatcaacgccatgtctgataacaaccaattgcagcagatcgcgcatctgcgccgtgaatacacgaaaggcggcttgcgtcgccgcgatttacccgctgaaccgttaaccttatttgagcgctggcttgggcaagcgtgtgacgccagactggccgatccaacggcaatggtcgtggcgaccgtagatgacaaggggcaaccgtaccagcgtatcgtattgctcaaacattatgatgaaaaaggcctggtcttttatactaacctgggaagccgcaaggcgcatcaaattgagcacaatccgcgtatcagtctgttatttccctggcatatgcttgaacgccaggtgatggtgacaggcaaagccgagcgtctctccacacttgaggtggtgaggtatttccacagccgtccgcgcgacagccagatcggcgcatgggtctctaaacaatccagccgcatttccgcgcgcggtatcctcgaaagcaaattcctggagctcaagcagaagtttcaacagggcgaagtgccgttacccagcttctggggtggttttcgcgtgagtatcgaacagatggagttctggcagggcggcgaacatcgtctgcacgatcgctttttataccaacgcgacgacggcgcatggaaaatcgaccgtcttgcgccctaaagatgcaaaaatcttgttttaagcactggtgcggatgaatccgccgttttatgctatgtctctttcgcgtctggcgaaaagtcgtgtaccggcaaaggtgcagtcgttttatacatggagattttgatggcaagcagtaacttgattaaacaattgcaagagcgggggctggtagcccaggtgacggacgaagacgcgttggcagagcgactggcgcaaggcccgatcgcgctctattgcggcttcgatcctaccgctgacagcttgcatttggggcatctggttccattgttatgcctgaaacgcttccagcaggcagggcacaaacctgttgcgctggtaggcggcgcgaccggtctgattggcgacccgagctttaaagccgccgagcgtaaactgaacactgaagagaccgttcaggagtgggtggcgaaaattcgtaaacaggttgccccattcctggactttgattgcggcgaaaactccgccatcgcggccaataactatgactggttcggcagcatgaatgtgctgactttcctgcgcgatatcggtaaacatttttccgttaatcagatgatcaacaaagaagcggtgaagcagcgtctgaaccgtgacgatcagggtatctctttcacggagttctcttataacctgctacaggggtacgacttcgcttgtctgaataaactgcacggcgttgccttacagattggcggttctgaccagtgggggaacatcacttccggtatcgacctgacccgtcgcctgcaccagaatcaggtatttggtttgaccgttccgctgattaccaaagctgacggcacgaaattcggtaaaaccgaaggcggcgctgtctggctggatccgaagaaaaccagtccgtacaaattctaccagttctggattaacaccgcagatgccgatgtttatcgcttcctgaaattcttcacttttatggacattgaggagatcaatgccctggaagaagaagataaaaacagcggtaaagcgccgcgcgcgcagtatgtactggccgagcaggtgacgcgcctggttcatggtgaagaggggctggtcgcggcgaaacggatcactgaatgcctgttcagcggttcactgagcgcgctgagcgaagctgactttgagcagttggcccaggacggcgtaccgatggttgaaatggaaaaaggcgccgacctgatgcaggcgctggtagacgccgaactccagccgtcacgtggtcaggcgcgtaagactatcgcctccaacgctgtcactatcaatggtgaaaaacaatccgatcctgaatacatctttaacgatgaggaccgtctgtttggccgctataccttattacgtcgcggcaaaaagaactattgtctgatttgctggaaataaggcattaagtaacagggagtgagaaatcactcccttatttttgatgttcaggtaaaaaaatgaagaatatcctcgctatccagtcccatgttgttttcggacatgcgggcaacagcgccgccgaatttcccatgcgccgtcttggcgcgaatgtttggccgctgaataccgttcagttttctaaccacacgcaatatggtaaatggaccggctgtgtcatgccgcccagccatctgactgagattgtccaggggattgcggacattggccagttagcgcactgcgacgccgtacttagcggttacctgggatctgccgagcagggagaacacattctcggtattgtgcgccaggttaaagcagcaaatccgcaggcaaaatatttctgcgatcccgtgatggggcatccggaaaagggttgtatcgtggcgcctggcgtcgcagagttccatgtgcgttatgcgctacccgccagcgatattatcgcgcctaacctgattgaactggaaattctcagcaaacatagcgtgaataatgtgaatgacgccgtgcaggtggcgcgagaactgattgctcaggggccagaaattgtactggtaaaacatctcgcccgcgccggttacagttcagaacgctttgaaatgctgctggtgacagcgcaggaagcctggcatattagccgtccgctggtggatttcggctcacgtcagccggttggcgctacagcgagctatccggcaacatgacattaattcagtccttccgctttaagcgctgccgcaacggtcggtctttttgcgacacgctgcatataactttcaatatgcgttgacccgtccatattcagttttacgccataggcccaacgcaatacggtaaacagataagcgtctgcaatggtaaaacgctggccgcaaatccactggtcgtctgaaagcgactcatccacatactgaaatttcttttccagaccggcgcgaacggcgggtttaagtgtttccggcgtgtcagggcggaacagcggggtaaagcctttatgcagttccgttgcaatatagttgagccattccagcgtatgatagcgagcaagactacttaccggcgccagaagctggcggtcgggaacgctgtcggcgaggtactgcataatggcgacgccttcagtcaacagtgtgccgtcatccagcagcagagccggaacctgtcctttagggttgactgccaggtaatcatcaccgttttccaggcgttttttcgcgagatcgacgccatcaagcgtaaagtctttgccaatttcgcgcaggataatatgggaagcaagagagcaggcacccggtttgtagaacagtttcatcggtaactcctttttgctgaggtttaaagtatggtagtgcggggacgagcaaaaaaaaagccgctaacgcacagttagcggcctgaatgttgtttcccggaaaattaaactgtagcggctttagagcctttttcagcggtatcatcgtcctgggtcatacggttcagcttaggcgctgtcagcagcatcaggacggcgataacggcggttgctatgccaatctgcataaatacgcgaccatagacttctagggacatcagtgggtcagtcacgtcgctcggcacagccatcaggttggcgacataaccgccgatgatgttagcgcctgccgttgtcaggaaccagctacccatgatgaagcccatcagacgctgcggaaccaactgtgcgaccattgccaggcccagaccggagatcatcagctcaccgatactttgcaggccgtagcttgcgatcagccagtttacggatacgatgccggcatcgttcgcaaatttggcgcccagcggcagaatcaggaacgcgccggaacacagcaccataccaatggcgaatttcatcggcatcggcagcgtatcgcccatcctgttataaatagcggccagaatcgggctgccggtaatgatccagaatgggttcagcgcctgatactgttccggttcgaacgcgataccgagaatagagtgctcgacgttacgaatggcaaagaagttcagcgacgtcggcatctggctgtacagtacgaagaagataatcgcctgcagcatcaaaataaaggcgacgatcattttacggcgagccgcgccgtgcatggaaaacgcttctttaccgaaaataatgacgatgccaagagcgattacgcccagcaccatacgcgcgatatcctggttgtgcagcagccaggtggcgaccgcaatcagaacgacaatacccacgattgtcagcagcagattacggaagttgatcggttcaaagtcgggtttggaaccgtagcttttcacccagcgctggcagaaagcaaagttaacgacggttatcagcataccgacgacgctaagcgcaaacgcggtgctccagccataacgcgccgccagccacggcgtcgccagcatagagaagaaggagccgatgttgacggacatataatacatcgtaaatgcgccgtcgagacgcggatcgtccttcgcgtaacaggtagacagcagggaagacgggttagctttaaacagaccattacccacagcgatagccgccatgcccatatagacgatgccagcgtcatgaccagaccatgcgaccagcgcataaccgatagccagcaccacggcacccagcataataacgcgtttggtgcccagaattttatcacctaaccaaccgccaatggcgaccaggccgtacaccagcgcactgaaggaagagaaaagggtgatggaatccgcttctgacatacccagttgttttaccaggtagacggccataatgccttgcaggccgtaataaccaaaacgctcccataactctatcgagaagattagatagaacgccttcggttgtttgaaagcgttcaaactgacgctttcagttggttttttgtttgcagtagacacttttacctcttttttacgccccgtattaacagggattgtctggcgcgtgatgagtcagactcatccgtccgattgttatattggaggggaaacggcaggtaatgttcactatctttcctctccagacaagagctttgtaataatctgttacatataactcttctggttgaatcgtccgatgtcagaaatgttatccagcgttaaatttcttcatttgaagaatggcagatttttacactgcaaaaaggccattagtttggataaaaggcgatatcttctgctatttaaggtgaaaagcagtgatataggccattatctgaaaaaatggcagagtaatgttttgtagtgaaaacggggcgtcagtctatccggttgtaaatgtaaccttaggtgtcattaaatttcacatgaagttatcaaagtgatcctgatcacggatagatagaaatttttgcgattaaaaaatgattaacctgacgtggagggaaaacgaaagcacattacatcagaaaaaggacagagactggaatgattgatggctaaaatagatccaggccgaaggtgggagcgcgctggtatgacgggcgcactccgaccatatcaaatatcgactttttctttgtattcgcaaaggtcttcaatgaggcaggagccgcagcggggttttcgggcgatacaggtatagcggccatgcaaaattaaccagtgatggcagtccactttgaactcattcggcaccactttcagtaacttctcttctacctgctcgacatttttacccggcgcgaactgtgttcggttgcatacacgaaatatatgcgtatcaacggcgatggtcggccagccgaaggcggtatttagcaccacgttagcggttttacgccccacgccgggaagcgcttccagcgccgcccgatcctccggcacttcgccattatgcttgtccattaaaatacggcaggtcttaatcacgttttccgctttactgttaaataagccgatggttttgatataggatttcacgccttctacgcccagttccagcatcgcggctggcgtattggcggccgggtaaagtttggcggtcgccttgttcacgctgacgtcggttgcctgcgcggaaagcaacacggcaatcagcaactcaaacggcgacgtgaaattgagttccgttgtggggtgcggattgctgtcgcgcaggcgcgtcagaatttccagcctttttgctttgttcatcagactttccctgtttcaccggccggaacagcggaaggcgcggtttcggcgcggcgtttcttcattttttcatcaataagatattttaccgccagcatgagtcccagaccgataaacgcgcctggcggcagcatcgccagcaggaaaggcgagtcggtgtgaaatatctcgacccgtaatacttttgcccagcctcccagcaggctatccgcgccatcgaaaagcgtaccattcccgaggatctcgcgcagtgagcccagcacgaacatcgcgcctgtcgcgcccatgccgatggaaaaaccgtccaacgcggaaagccacggtccttttttcgcggcaaacgcttcggcgcgaccaacaactatgcagttcgttacaatcagcggaataaaaatccctaaagactgatacagaccgaacgcatacgcattgatcagcatctgtactgcgctgaccaccgaagcaatgatcataacgtaaatcgggatacggatttctgccggcgtccagcgacgtagtgcggacaccgtaaggttggtcagcgttaataccagcgttgtggcgagacccagccccagagcgttggttgccgtagacgtcactgccagtaaagggcacaggccaagtagctgcaccagagcagagttatttttccataacccctgaacaacaatgtcttttatttcgctcatggctattctccacaggcggttaaatgggggagctgagcgggcagtgattcggcgtacagcccggcgcgtttaaccgcattcactacggcgcgcggcgttattgtcgccccggtaaattgatcaaaatcaccgccatcttttttcaccgcccagtgcgtatcattttcaccgctgatggttttaccgctaaagtgggtaatccagtcagacaaacggcgctcaattttatcacctaaccctggcgtctcatgatgttccgtcacgcgcgtccccaggatagtaccgttgaaatctgcgccaacaataagctggatagcgccggaatagccatctggcgcggtggcctcaatgatggccgctacgggtttatcatccttgcgagcgataaaaacacggtgtgtgcctttgccgagggcgggcgcatcgaccagataacagctctcttgcagattattattgtaacgatctggcggcaatacctgatcgaacagggcatgttgttgttgcagcgcttgttcgtggatggttgattttgtcatctgattaatcaccgcggtcaatcccgtagagcctgcggcaaaaagcgccagcgtaataccgtgtttacgaatcgttttcagcatggtttatcctttgcgatgtccatagacgcgggggcgcgtgtagtagtcgatcagaggaaccgtgatattcgccaacaggacagcaaaagcaacgccgtccggatagccgccgaagctacgaatcagccacactaataccccagccagcgcgccgaaaattaaacgtccacggttggtcgtggaggcggtaaccggatccgtcaagataaaaaatgcgcccagcatggtggcgcctgacagcagatgaagctgcggcgaggccagcgtagcgggcgagaaaagccaacctaacgcggcgcatagcgccagcgtgagcagaaaactgaccgggatatgccagcggatggctttttgccacagcaggaatacgccgccgacaagccaggcgaggttaacccactgccagcccacgccagccagcgcaccgctgtatatcgggtactgcatgatttgctcaacggagtgcccggcgcgcaaggacgttttaaacgtatccagcggcgtcgcctggctgataccgtcaataccgatacgtagtagcgtcatatcgccgccgctggcggtatgcccgctaaaaatcatccgtaacgtgtccagtatatcgggcgttgttgcggctatttcataaggcggcaaccagcttgtcatttgcaccggaaaggaaattaatagcaccacgtagccgatcatggccggattaaaggggttttgtcccagcccgccatataactgtttagcgataataatggcgaatccggttcccagcacgaccatccaccagggcgcgagcggagggatgctgaccgccagcaaaagccccgtcaataacgcggaataatcctgcaggtgactggcgaccgattgtttgcgcagtctaaggacaatggcttccgcgacgagcgccgtgatagcagccagaacgatctggaaaagcgttccccaaccaaaaaaccacgtctgcgcggcaatccccggcagagcggcgattaataccagcaacatgattcgcgatgtctggcgctggttatgggtataaggcgagcttgcgattctgaataccatttaatcctcgttaacaacctgctgctgtgctgctttttttgcctgaacgcgagcgatagccgcagcaaccgcggctttacgcgggtcggccggttcgacaggttcgcttacggtctgctgctcctgcttacgggctttggcacgggcgatcgccgcttccaccgcggctttacgcggatcgaccggttcggcgggttcgcttccggcctgctgctcctgtttgcgggctttggcgcgggcgatagccgcttccaccgcggctttacgcgggtcgaccggctcggcaggttcgcttccggcctgctgctcctgcttacgagctttggcgcgggcgatagccgcttccactgcggctttacgcggatcgtcgccggatatcgcgctgtcagccatcggatgagcggcttgtttagcgcgcgcttgcgctttacgcgcttcacgggccgcgatgacggcgctattgtctggcagactacccgcctgaataaccaccggttgcgtggcctgcgcctgtttctcttttacccgcgccagcgcagcggcaatggcatcctgatcttttgccgctggttgtaccgctgcgctcttgtgacgtgcaaggcgggcggctttttcgcgctccagtcttgcctgacgagcctcaaaacgcgctttggcttcggcggcgcgtttttcttcaagcctgatcgcattaatctccgctttttcctgacggaaatattggacgagcggaatattactcgggcagacccaggcgcaggcgccgcattctatacaatcagcaatatggtgagcggtagccttgtcatgctgctgccctttgctgaaccaataaagctgctgcggtaaaaggtcggcagggcaggcgtcagcgcaagcgctgcaacgaatacagcttttctcttcctgaggcgcccccatttcagtcacggatggcgccagcaggcagttggtgatttttacgaccggtacgtcaagccagggaagggtgaatcccatcaacgggccgcccatgatgaccatctggtcagcagaggggcagaacccggcatcgttaagcaaatgacgaacgggagtgccgagccgcgcccagacgttacccggacggcttatcgcttcacccgttaaggtgacgacgcgttctgtgatcggttcgccgtcaaccacggcgcgtttcacggcatatgccgtaccgacgttttgcatcagcacgccaatatcagaggagcgcccgccgtggggaacctgttttcccgtcagtatttgggtgagctgttttgcgccgccggaagggtatttggtcgggataacacgtaatgaaatatcatgagcgtcagccagtacggcgcgcagcatggaaatagcctgcggtttgttatcttcaatgccgattaatacctcacgcggttgcagaatatgcgccaggatgcgaataccttccacaatctgcgcggcgcagtcctgcatcagacgatcgtccgccgtaatgtaaggttcgcactctgcggcattgataataagcgtggtgattttatcgtcgccgccctgcaatttaacgccggtgggaaaccctgcgccgccaagcccggcaacgccatactgatgaatgcgttcaatgagcgcttcacggctgtgggcgcggtaatcagaccagccctcgcgttcaatccagcggtcctcgccgtcggcatcaatgatgacgcttaactccgccagcgccgaaggatgcgccgtcgagtggggcgcaatagcgataaccgtcccggaggtgggcgcgtgtaccggcagcattctcccacgtccacgggtaagcgcctggccgcgtagcacgcgatcgccgacgctaacgcacagctcgccctcagcgccaatgtgctgttttaaagggataacaaagcgcggcgccaaaggcacctggcgcagcggcgtgccgtttgactgggacttcatttcgggcggatgaataccaccgtcgaaatcccagattttatcttttctgaaagcggaaaatagtttaagcatgttgttccacgggaatgatgcgaacgggaatggtgttcaaatcccatttccaactgtcgggcgtctcattcaccggacgtaattcgatgcagtgcgtcggacacggatcgacgcacagattacagccagtacagagatcgctcatgaccgtgtgcatggcgcgcgttgcgccaacgatggcgtcaaccgggcaggcctgaatgcattttgtgcagccaatgcagttattttcatcaataactgccagcatacgtactggcgcggcctgctgttcttcaccatcgcatggttgcggctctacgtttagcaactctgccattttcagcatgacggcttcgccgccgggcgcgcaacgattgattttctcgccctggagacccacggcttcggcgtaggggcgacagccgggatagccgcactgaccacactgactctgcggcaaaatcgcatcgattttttcaacaaccggatcatcttcaaccgcgaatcggcgggaggcataacccagaatggcgccgaacaccagacccagaagggtcagggcgccaacggcaatccagatagtattcattacaacttcaccaaaccactaaagcccataaaggccaaagacattaatcctgcggtaatcaatgctatcgcgttaccacgaaaaggggcgggcacatccgccacggcaaggcgttcgcggatagcggcaaacagaaccatcactaatgaaaaaccgacggcggcggaaaatccgtacagcgccgactgaagaaagtgatgaccgagattaatattcagtaacgctacgcccagaaccgcacagttagtggtaatcagtggtaagaagatgcctaacaagcggtataacgccgggctggttttccgcacaaccatttcggtaaattgcacgaccacagcaatgacgaggataaaggccagcgtccgcagataaatcagatccagcggaataagtatccaggtgtcgataagccaggcgcatatcgacgccagcgtcatgacaaaggtcgtcgcgaggcccatccccatggcggtttccagttttttggatacgcccataaagggacaaaggcccaggaatttgaccagtacaaagttattgaccagtacagttccgacaaagagcagcaggtaatcagtcatgtttcggcctgaaataaaaaagccgcctattatctgtcaaactaccacaggcgacaacaggttaactgtagggttattacggattaacaaacgttgttttaacgcgcgctgaacgtttgagataaggcacaatgagcgccgtcgccaacagtgggaagagtaactgacgcacggcaaaggcatctgagacgggcgaaaaggcaaatgctttaaccgccagtaacaccgacaccagcagccagataatgtaatgctttggcacgcagcgtctgcgcttgaagaatgcgatcgtcaaccacaaggtatagtaccacatggcgatagcggtaataaatgaaatgccccatagcagtaaattaccggtttcctgtccgctaagcgttttgaacgtttgcggtgtggcaagcgccataacgtagagtaataacgccagcgaggcgctcaacaacgcgactaacagccaggctaacgggccaagaagccagcctccaattcgttgtggcggtgttgtagtcatatcttctccggggttacgcgcgttaacggtcatgccgctcattttggggcaaatattataaggtttttgatgttaaacgctactttctttattgcacatagcgccagacggattgcggaacctgacctacatcaaacaggcgtcctccggaaaccagctcggcacggcggtgatctgcagcgcgatacatattaacgatgtccatgtcatcagtaagggtatagttaaggtggtcgaacagtttttccagactttcgagcgaactaattttgcggaattttaatagataatcctgaacagtcatataaagttgatccatattaaatataatgccaacggagtagtcactgataaaaaaataaacaaaattgcaccagtgagaggtcaggggtgcaggtaaaaagggaatattcttaccggtaaagagtcaggcgccacatggcgcctggggcgaaaggttaacgcgctttactacaacaggcaataaacgtcagaccagatagaacatatttcgttttttttgccggtttttgacttttctttgcacgccccggggcgctgcttaccgtaccgcgcgaaaatgcctttacattatctgacgcttacttcttctgaacggaagccgtgggctcaggtggttggtaattgtcaatatggttggcaatacctaaaagaatgactgagataatgagaactatccacccagttaattcaataagacgattcattattgacgacatttgctttgatttatccataaacacagagagtaaatgttactttcctggcgaacggtcggcaagagggaggggaacgatttcagcctctgttctgtaacaagttaatcatttgatgctacgttgatggtcaggacgctattgcggctagtcgcacgatggtgtggaatagcgatatctaaaaccggaggcagtgagatgaatgacaaaatccgcgttgggttaatcggttatggctacgccagtaaaacctttcatgcgcccttaattatgggaacgccagggttagagcttgcggcggtatccagcagcgatgaaacaaaagtgaaagcagactggccggcggtctccgtggtctctgagccccgacatttatttaacgatccgcatatcgacctgatcgtgatcccgacgcccaacgatacccatttcccgctggcgaaagctgcgctggaagccggtaagcatgtggtggttgataaaccctttaccgtgacactgtcacaggcgcgagaattggatgcgcttgcgcggagcactggtcgggtactttccgtcttccacaaccgacgctgggacagcgattttttgacgctgaaggccttgctggcggatggcgtgctcggcgaggtgtccttgtttgaatcccactttgatcgcttccgtccccaggtgcgcgaccgctggcgcgagcaaggcgggccgggaagtggtatctggtacgatctggcgccgcacttgttggatcaggccattcaactttttggcctgccggtcagcatgacggtggatttagcgcaactgcgtccgggcgcgcaatctacagattatttccacgcgattttatcctacccccagcgccgcgtgattttgcacggtacgatgctggccgcggcggaatccgcgcgatacatcgttcatggttcgcgcggtagctatgttaaatatggcctcgatccccaggaagaacggttaaaaaacggcgagcgtttaccgcaggaagactggggatacgacatgcgtgacggcgtattgaccctggttgagggagagacgcgcaaagaagagaactggcttacgttgccgggtaactatccggcatattatgccgccatccgcgatgcgttaaacggtaacggtgaaaatcccgtgccggcaagccaggcgattcaaattatggagttgattgaactgggcatggaatcggcaaaacatcgcgcgacgctgtgtcttgcctgagatgtcgcatttctccgcctgggatagcattaaaccgcaggcggagaagagcgttagtgtcaataaagcaatcttacgccgcggccactttttcgcgtagcgcacgtttttcgctatcgctcagaaaggcgatttccagaccgttaatctgcgcctggcgaatctgttcgcggctcaatcctgccgctggcgcggcgacgtgatattcatggataatatctacgccctgaacagccggatcgtccgtattaagactggcgagaacgccatgctcaaggaaggtttttagtggatgatccgccagcgatgcgacggtactggtctgaatattcgaggtcagacaggattcaataccgatacgctgctgtgcaagaaaatccattaacgcgcgatcttcgacagcttttacgccatgtccgatacgctcggcccccagttcgcgaatcgcctgccagatactttccggccctgcggcttcgccagcgtgaacggtaatatgccagcccgcatcgcgcgcccgattaaagtgcgacaaaaacagactgccgggaaagccaagctcatcaccggctaaatccagcgcggtgattttctctctgtgcgccagcagcgcatcaagctcctgtaaacatgccgcctcgccgaaggtacggctcataatgccaatgagtcgtgcctcgacgccaaacgtgttacagccgtcgcgtacaccgtcgataacggcttcaaccacgcctgcgatcggtaactgatgcgccatcgccatatagccgggcgaaaagcgaagctcgacgtaatgcaggccgttacgtgccgcatcttcaatattttcaaaggccacacggcggcaggcgtcaagcgatgccaggacttttaccccccaatcgagtttagtgagaaagcttactaaatcgggttcggttgaggtgacctggacatgcggaatcagcgtttccagcgtttgggcgggaagggcgatgttgaactgccgaccaagatccagaattgtttgggcgcgaatgttgccatcaaggtggcggtggatgtcagtcaaaggaagcgtaatatcaatcatgggcgcactcaatttttaataaaagtgcgcaccattatactacagattgataatgctctggaaattttgcaaaaacggagtcattacgttgcaacttcgcgagagcgcgggagaaattttgtatcattctctgtaacgcgcccccggtcagctcacgggggttgtctctgttatcgcctctcaggataaagggtcaaccccccgcttgtagacggtatcagcgaacggcgcggtggcaaaatccatatccgagatcgtaaaggggagcagatcggcttcgccaaaacgatcggcgacataatcccactacgtacaccatgtcccgcgtcggtcaacttcctgtgaaaaatcgaacatatcccttccttatgcctgaacggtattcatcaggccaaccatttcatcttttaccgactgaacctgcgggccgataattacctgcaaattatgctgattgagctgtacgatgcctgtcgcgtgattgtccttcaatgcctggacatcgacaaacgacatatctttcactgacaggcgtagggggggatgcagttgtccagactcacgatgttttccgtgccgcctaatgctcacgacgagcaccatgtgcggagtcaaacgatagccgctcgcctggtaacgcaaaagtagaggctgcgcgtcgttcggcgcagaccgggtgcagcgtcgcgacacccggcaaggcgattattgttgaggcagcgccggaacgtccggaacggaaagcgccggcatcccaaataggccgacaaagtcttccaacggcattttttgtccgttgagcgtgatctggccattggcgtactgcaaactggaggcgatagtattatccttcagcgttgtcagtcggaacatctgacccattgcggacagcccctgcacctgctgttttgccagtttttccgcatcatcctgctgatagccttccagttttgctatctgcgtcataaactcgaccgccatgtccatcggaattgccagtttcgcatccagcgatttcacggagcggtcgacttcctgtgccagcgtttgcggttgtgccgttgtggttgccggatctttgaggaacagcgacagattcagcgtggtttcccctttggcgtttttccagctaagcggcgccagggtcagaaccggatcgccttttaacagcacggggagagcgctaaagaacgcttcagtgactttttgctgataaagctcaggattctgcgccacgtccggctgattcagcagcgcctgcgtttgcgcatgatattgctgactaaactggtgccaggcttcgccgtcgatttgaccgactttcagcgttaatttaccgctgcccaaatcctgattctgcactttcaggctgttaagcgagtaatccaactggctgttaatggtttttccgtcgttgacgagatcggacttgccggcaatttccatcccttccagcaccgccatctctttaccctcaatggcgatggacagtttatccagcgttaacttttggtcgcctacacgctcgccaaagcttgccagcttactggtaccgtctgttttcaaattattaaaggtgagttgtaccttctgattatattcgttaacggcatcgaccaggccgctctgcgcttcgcccgacagcgaaaccacattaccgtctttatcggcgttaagctggaactcgccgccgctaaaggcgaccttttcaccggcattctcgtagtttaacggcttgagagagatatcggagcgggtatcgccgccataaccaatgcgggtattgataacaaagggcgcgtcgcctttcgcaatatcaaagaggggttttgccgcatcgttattcaccagagtggtttttaccgacgccatagaagggatcagattgagcgttttgagctgggcgagcgggaaggggccatgtgaaacggactcgtccagcacaatgctttgcccgggcttcaaccaggtattgtctgcgccggcaaccggtttgacaaccagttgcagatggctactgaacacgccgcgctggtagttttgataacttaattcgacaccggcctccggcgcagtacgcttgagctgttcattggcctgagtcaccatttctgcaagatggttctccagctttttccccgtataccaggcgccgcctgtccagacgatgccaagtgcaattactacacctgcagctaccagtgtttttttcatatcaattgtccataaaaatgaaaccaggcggattaaaccgcctggaggagttttacgtctgttataagcttagcaagagttgttaaaaaattcagtacgttgctacagcttgttataaacacgcgctaaacggcccgtgccgctggcgttaaccggagactcatccgcgccgataaaggcagattcacccggcttcagtaccagacgctgttcatctttacgtaacaccgcctcaccctcaacgcagaacagaatcgcggcgctgtgttggccgatgctcgtctcctgaagcgccaggtcgtgcagtgaaaaagcaaaatcgtcaaccggaattgggaagtccagctccgcgccgcttttcaccggggcagtcagcaactcgccggcaggcttaggttcgaacttcacgttcgcgaccagctcagggatgtcgatatattttggcgtaaggccagcgcgcagaacgttatcggagttcgccatgacttccagcgcaacgccctgcagataagcatgaggcgtttcggcaaacaggaacatcgcctcgccgggattcagtttgaccacattcagcaacaaaggagagaaaagcccgctgtcgtcaggataatactctgaaatcacgcggatcgtttgccacggttcgccttgctggctgttaagcgccgctttgagtacggctaacgcgcgggatttttcttcgccttgcatattcaacaggctggcgaaaagctggctcagacgttcagcattcggcgcctgcaaaaagtgggcgatagcggaatgcgcgccggcgacaggttgcagtaaagagacaatgtcagaaaattcgcggaacgcgttcatcgccaggaaaggcgccagggcaaaaaccagctctggtttatggttaggatctttatagttccgctctgcggcatccatggggatacccgccgcattttctttcgcgaaaccgatttcggaattgcgcttattcgggtgcacctgaatagagagcggctgcgcggcgcacagtactttaaacagaaacggcagttcgccgaaacggttggctaccgcttcgcccagcatggcggttttattcttttcgatggcgtcacgcagggagacggtttcgccgttggcggtggtgattcgcgagctgcttttgggatgcgcgcccatccagagttcagccattggctgctgctgcggattggcgatgccataaagttccgttaacgcagttttacttccccaggcatagttttgcactgagttaatgagtttttgcattatcaagccctgtttcaatgtggagatcaatgggaggtattaaaccaagaaacccgcatgaagtaacctccgggcgtaaaaagtcgtacttgtctcagtttttgttaaaaaattgtgtaggatagtgtaactcgctttgagtcgggcaatggaacacctgcccagagaataaccataccgagcggtaagtgagagcacaatgtcaaacaaacccttcttttatcaagacccttttcccctcaaaaaggacgataccgagtactacttgttgaccagcgaacatgtttccgtcgccgagttcgaaggacaagagatcctgaaagtcgcgccggaagcgctaacgttgttggcgcgtcaggccttccacgatgcgtcttttatgctacgtcccgcgcatcagcagcaggtggcggatattctgcgcgatccgcaggccagtgaaaacgacaaatatgtcgcgctgcaattcctgcgaaactccgatatcgcggccaagggcgtgttgcccacctgccaggataccggtacggccattattgtcggcaaaaaaggccaacgcgtctggactggtggaggtgatgaagcggcgctggctcgcggcgtatataacacctatatcgaagataacctgcgctattcgcagaacgcgccgctggatatgtacaaagaggtcaataccggtactaacctgccggcgcagatcgatctctacagcgtcgatggcgatgaatataaattcctctgtatcgctaaaggcggcggttcggcgaataaaacctacctctatcaggagacaaaagcgctactgacgccgggtaagctcaaaaattatctcgtcgataagatgcgtacgctgggcaccgccgcctgtccgccgtatcacattgcgtttgtcattggcggtacctcggcggaagcgaacctgaagaccgttaagctggcctcggcaaaatactatgatgcgctaccgaccgaaggcaatgaacacgggcaggccttccgcgatattgagctggaaaaagaattgttgcttgaggcgcaaaatcttggcttaggcgcgcagttcggcggcaaatatttcgctcacgatattcgtgtcatccgattgccgcgccatggggcatcgtgtccggtaggtatgggcgtgtcctgctccgcggatcgaaacattaaagcgaagatcaaccgggaagggttctggatcgagaagctggagcgcaatcccggtaaatatattccagaggcgctgcgccaggcgggagagggcgaggcggtgcgcgttgatcttaaccgtcccatgagcgagatactgcaacaactgtcgcagtatccggtatcaacgcgcttgtcgctgaacggcacgattattgtgggccgcgatatcgcgcacgctaaactgaaagaacggatggacagaggcgaaggtttgccgcagtacatcaaagatcatcctatctattatgcggggccggcaaaaacgccggaagggtacgcctccgggtcgcttgggccgactaccgcaggacggatggactcttatgttgatcagctccagtcgcagggcggcagtatgatcatgctggcgaaaggcaaccgcagccagcaggtgaccgatgcctgtaagaaacatggcggcttctacctgggcagtatcggcggcccggcagccgttctggcgcagggcagtatcaagcgcctggagtgtgtggaatatcctgaactgggtatggaggctatctggaaaattgaagtggaggattttccggcctttattctggtggatgataaaggtaacgatttcttccagcagattcagtcatcgcagtgcgcgcgctgcgttaagtaatgtcgccgccctgcggggcggtaacatgattcgctattttgccggagaacggcgcaagcgccttatccggtctacaccgttgtgttgttatcgttaatactcataagaccgcaaacatgtgagcaatgtcgacacatgatctcatcaacttgagtaaggagcaggtaatggtaacggtacgccgcgagaaagattcaatgggcgtgattgaagtcccggcagataaactgtggggggcgcaaacgcaacgttcgctggagcattttcggatttccacggagaaaatgcccgtctcgctcattcacgctctggcgttgaccaagcgcgccgctgcgaaggtcaaccaggacttagggttgttggcggcggaaaaagccagcgcgattatcgaggcagctgatgaagtgctggcgggaaaacatgctgatgagtttccgctggcgatttggcagaccgggtccggtacgcaaagcaacatgaatatgaatgaagtgttagcgaaccgcgccagtgaaattttgggcggcgttcgcggtatggaacgcaaagtgcatcccaatgatgacgtcaataagagtcaaagctcaaacgatgtgttcccaaccgccatgcacgtggcggcgttactggcgttacgcgaacaccttatcccgcaattatccgcattaacggatacgcttcgcgataaatcccacgctttcgccgatattgtcaaaattgggcgtactcacctgcaggacgcgacgccgctcaccttaggccaggagatttccggttgggtagccatgctggaacataacctcagacacattgagcacagtttaccgcacgtcgcggaactggcgctcggcggaaccgcagtagggacagggcttaatacccacccggaatatgcccggcgcgtggccgaggaactggcgaccattaccgcggcgccgtttgttaccgccccgaataaattcgaagcgctggcgacctgtgacgcgttggtacaggcgcatggcgcattaaaaggactggcggcctcgctgatgaaaatcgccaacgatgttcgctggctggcatccggcccgcgctgcggcattggcgagattgctatcccggagaatgagccaggcagttccattatgcctggtaaagtgaacccgacccagtgtgaagcggtaacgatgctatgttgccaggtaatgggtaacgatgtggccatcaatatggggggcgcatcgggcaactttgagctcaacgtctatcgtccgatggttattcataattttctgcaaacggtgcgcctgctggccgatggcatggcgagtttcaatcaacactgtgcgtcaggaatcgagccaaaccgcgagcgtattacgcagttgctgaatgagtcgctgatgctggtcactgcgctcaatacgcacatcggttacgataaagcggcggagattgcgaagaaggcgcataaagaagggctgacgctcaaagcctcagccgtggcattaggataccttagcgacgcggagttcgacgcctgggtacgtccggagttaatggttggcagtatgacgccgggacgttaatccgccacatacaggtgcagtcgcggaataatcagtcgcagcggctgcgcctgtggtttaaaacggtgctgaatattatcggcgtcatagttttccagcccgccaatatccggcacgccagcgccgttgtccgtgttgattaatgcgataatcggcgaggggcaggcgtgttgcacctgtttctgctggcctttataccagatgcgggcgatcggctgtaccttaaccgggcgcttaatcttgagtttggcctgctgcggtaaggcagcgatatcctgatattcccgttccagcttgaattgccattgttcgcgcgtccacggcgggacgctgcgcggcgacgcgaggctttttttcaactggctcagaacctcatcccggcttaaatttttaataatatgtttatttgcccaaccgaaacgtatggtggcggggttattgataagcgtcagcgtgcggtaagcgttcagcgtaattaagccgggtagatgccgatgcacccactcaaaacgtgccgctgagggaagaccggactctaccgtaaccatctgctcgaaggtggttttcaactggttaatgcgctgtacctgattttccagatctaactgtgtcgcattatccacttgatagcataaaacgccaggcaggcggacggcggctttactgctgcggttttcggactgctgttgaataaacaaatggcgatagtgacgtagcgccagcgcttcggcctctttccccagatgttgcgtgacctcgatagtgtccagcggcgcatgttccgcctctttggtcacctgcggcagtgaaaagacactagcgataagtagcgaatgctgctgtagattatccgacagcgccgccaggtgttgttctatctggcgaaaagtgccattcaggcgttcaacgagatcgtagcgggacatggtatcactcactttagttacaacatactatctgtatagcacaattcccgcggctcaaccagcgtgcaaaatacgtcaggccgcggtcatgtcgggcatcgcgtgccagaccggccagcgaaagctaaattttgcgccgcccagttcgctatcgtcacagacgacgctaccgcccatcgccagagcgatagagtgtacgatggcgagtccaagcccgcagccgcctgtcgcccggtctctactggggtcgagtctgacaaaaggttcaaatacgcgctctcgcgcatccgcttcaatgccggggccatcatcttcgactatcagcgttgcctgactgccgtcaagtaacagactgacctgaacggtggtacggctgtagcgcaacgcattattcagcaggttatccagcactcgcgacattaaccgcatatcaagcgcgccataatcgccgattacacatgtgagaagatttacggcgcgttccgggttcacgctctgcacatcctgcaaatgcgcgaacaaccaggcggggaggtcgggtttggtcaacatcagttcattttgtggtcggtcaaggcgcgcataggtgagcagttcttcaatcagcgcttccagttgaccaatatcgcgattgagcgcctgtgattccggcggagtcagattttcactcatttcaagccgatagcgtaaacgtaccagcggcgtgcgaagctcatgggcgataccgtcaatcagctgttttttactggcgatcagagcattaatgttatccgccatctggttgaacgcgacgcccagacgttcgaaactggaaccattatcgaaatgcaggcgttcagtcaaatgaccctcgccaaagcgctgcgcggcggattcgagcctgagcatttcttgccagtgcgggcgcatccagataaacacaggaaaggcgagagaaaaggcaatgagcgccattaaggcgatatccagcagtcgcatttgatgcaggaaatagagatagggaaccgggccaaccgccaggacgtaatggctgcgcgggatacgctgaataaaggtgtattgatcgtcaagcgcgacaatatcgccttcacgcagtcgctgcgtggtggcggcatcaagcttatagtgatttaacggttcaacgcgtaaatcgaaagagaggttcaggtccatctcttttaacgttttcccccattcacgcggcggaatttcccgcagttcgctgcgcatcagatagagcgaacttttcatcagatcgtcgagcgattgcctgcccgcgcgttcggcagtgaatttgtacaccagtccgaccaataaggtcatgaccagaaaacagacgaacagcaaaaggtaaaactgcacaaacagctttttcatcaacgcccaccggatctcaatacattagctctatcgcgcgctgacggaaaagatttcccgtcagcgccgctggtgggttataaaagcaggctttgcgtcaactgacaacctcattgtccggcgttaaggtccggactttcgtgaacaatgcgtccatcgacaagcgtcaaaacagcgcgaatggtatcaattctgtcttccggcatcgtcataaagggctgattgagcaccgccagatcggcctgttttccgacgctaagctggccccggtgttgttcggcaaaggcgagccaggcggcatgacgtgtatataacgctagcgcttccagacgcgtgagccgctcgctggcgggtttacgcacggaaccgcctgacgctataccggtgatatgatattcgatagcgtgccagacaccggcaatgccaatacgcgtcgaatcggtgccgccagctacgacaagccctttatccagcgccagtcgaaccggcggcgaattgtccgtcgcaccgggtgggttggcgtcacggatggcaagcccctcaaagtaaggccccatttgcacagtgtatgccagacccagcttacgcattcgctcaagtgtctgtggcgaaccggtattcagatgcgcaatagaccagcggagagggcgcagatcgtactgctgcgctacctgctcaaaaatcgtcaatatcgcgtcggcgctgtcatcggtataggcgtggatctcaagcggtattccccgttttgccgcaaacgtcgcgacctggcgaagcgcggttttgtcctgctctgaggaagaaaaccctggggccatccgcacgccgtcattcattcctgccaccaggctttcccccaggccaagaaaagccagttgcccgtcgtcggcacgcgccgggcgaaaggccatcaggttgctgaaccactgcgcttcatgacctttcgcttccggctgtaccggaatgcgataccccacgcgcagcggtaaatccccctggtttcgcattgcaaataaaggctcataagcggcggcaggcccggcagaggggtcaatgatgccggtcacgccgcgagcgttcatatcagcgaaaaattgtcgcagaccgccctcgcgatcggcgttactacttatgctggcaaaaagctggttaaacgcggcgatgtcaccaaataatttccccgtggcgctaccttttgcgtcgcgctctacgcggattcccgctaaatcaggaggaggggtgtcgttaaggccaagtacgtctataccgcgctgattcactaacgcatagtcgtaaagatactgaatataagccggatgatcgggaagggcgtggctcagttcggctaccgtcgacgcccggttttctgcaaattgcgccggtatccatgatcccactacggctacccattgatcgtggggacgacggttagcgtcggcgcgtaatttatccagcgcgtctttaagcgaagggctgtcgtaccagtaggtttcgaatgtccaggtttgtccgccgcgaatggcgtgaatatgggtatcggtcaggccgggtatcacggttttaccctgtaaatcgatggtacgggtatggtcgccgcgccattcatttgtcgccgtatcatcgccaatcgccacaatccgcgagccggaaatcgccagcgcgctggcctgcggctgggcatcattcagagtgatgatattaccgttatgcaaaataatatccgctgccgggcgggcggcggtggctgcgcctgtggccgtgagcagaaagagaagcgcggttctggaaagcagaggcgggacgagactgatcattagcatgttccttttgtcgggagataagcaaaccatagagagcgaacaagaattgttcaatctgtgcccagggaacagtgcgttctgtttttagaacggtggtgatagaaaaagaaaagcccgccgaaacggcgggcttgagaagaattaatgaataattagaactggtaaaccatacccagcgcgacgatatcatcagtgctgataccggcatctttatagaacgggtcgtcgtcatccagcaggttgattttataatcaacataggtggagaagtttttgttgaaatagtaggtagcacctacatcagcatatttaaccaggtctttatcatcgccattaacgttgttataggtcagatctttacctttagacatcaggaaagaaaccgccgggcgcagaccgaaatcaaattgatattgggctgtaacttcgaagttttgcgttttgtttgctacgccgccatcataacccttgtccgttttaccataaggcgtcatattacgggtttcagaatacatagtcgctaaatagatgttgttggcatcatatttcaagccagctgtccatgcatccgctttgtcgccgccagcaatcgtgccgccagcattgacttgctcattagtacgatcggaagtggtatacgcagcgcctgcgctgaagcccatgccaatatcataggtagtagaaataccgaagccatcaccgttatcgtaacgaatatcgtcgccattattacggttattggtaccgatatttacatcgtcagcgctttggctttcatttttaccctgatattgcaacgcgaagttcagaccgtctaccagaccgaagaaatcagtgttacggtaggtggccacgccgttagcacgaccggtcatgtagttgtcagcgtaagtataggagtcgccgccgaactcaggcagcatatcggtccagccttccacgtcgtacaggacgccgtagttacgaccatagtcgaatgagccgtagtcgccgaatttcagaccggcgaatgccagacgagtccaggagttcgcgccttcgccttcggtagtgttagcctgaacgttatattcccactggccgtaaccggtcagttggtcgttaatctgcgtttcgcctttaaagccgacacgcatataggtctgatcgccatctttagaagagtcatcagagaaatagtgcaggccgtctactttcccgtaaaggtccagtttgttgccgtctttgttataaatttcagcggcgtgtgctgcgccagcagccagcagagccgggatgacaagtgccaatacttttcttttcatttttttatccttaaaaacttaacttatttgcaaaagattgaacttctacagattcgttgaatcaaaggcatcctaatctgaataatattatttcagcaaatgctaacttttcttatatgttattaattaatacaaaagttactatcggaaacgcatatatttatggtgaatatgtttgttattatatattcatggttgtgatttgtttgatttcacaatttgcgaaaaaagatggcaatatagcggcgggcagacattctgttatcaattttgtgaactggcttcgagttttttttaatttaattttcttgagcgaaaaagacgtaatcatgaaccgcaacgcagagaaaacggtaataaaggggctgttccgactaataaaaatagcactgatgtatacggtgtctgttttttgaacagtggcggtgatgagcatcgccactatgacttgataaaggcaggtaaaatctgtcgactcacttatcccgtcgtttcgtcccaggcatgaggggcaaaaagatagcctttattgcgaatggtctttatacgatagggctcagcagcgctatccagcagtttcttacgcaggcgggaaatcgccacatccacgctgcgatccagaccatcataattaacgccgcgcagcgtttttagcaacgcgtcgcgatccataatttgtccggcgtgtgtcgccagttcccagagcaattcaaaatcggcggtggagagcgatatgaaatcgccattgagctggaccgcccggttaaggggatcgatggttaacgcgccaaaacgcagcgctttatgcggcgtaagcgcgctctcctgaagactttttgcctgttgcgtttgttcgctttgccgcaggtgtaagcgcagacgcgccagcaaaacggccggaggcgtggttttgaggatgtagtcgcaggcgcccatctccagcgccagaatatgattcatatcactgtccagcgaggtgagcaggacaatcggaccttgccagcggtggcgtaaatcgcggcatatcgtcatgccatctttacctggaagcataatatccagtaaaaccagatcgggctgagtgatgaggataagatcctccgcccggtcaccacgcggctcaacaatgacatcaatatcatgtttcgccagataagcggcaatgagagaacccacttcagcgtcgtcttcaacaaatacaatgcggttcatattataaatggagaatagaaaacgccaacatacacctcctctgttttcccttccataaatcttttctaaacgagagcggttccgttatgctacatgctgttgttattagcatgttaaggcaaggtaatgggactcgtgattaaagctgccctgggggcgctggtcgtcgtattgattggtctgctgtcaaaaacaaaaaattattatatcgccggattaattcctctgtttccaacgtttgcgcttatcgcgcactatatcgtggctagcgagcggggcatcgacgcgatgcgtaccaccatcgtctttagcatgtggtcgatcattccttatttcatttatcttgcaacgctatggtatttcagcggcgtgatgcgcctgcccgtcgcgcttggcggtgcggtggtctgctgggggctaagcgcgtggctgctgattttttgctggattaaatggcattaatattggcaaagaccgtggtttccccatcgtaatacagacggatattacgatagggaggttgttaacccaccagcatccacgtagccggaaccgccgcgaccagcaataaaccaatcagcacgacttcctgacgatttaatacattgtcatgcttgtgcgtccgacgcgcatacaggaaaaccagtaatccaggcgcgtacagtacgacggacagcagcaggtgcatagggcccgacgcatataataaccataagccataaatacaggctccgataccgaccgcccgatggaggggacgcgttgcaatcttcagcagaaatgcgccgaccagaaagtagggcaccagaatcatttctgacgcaatcgtcaatagtgtgttgtagtccgaaccggtcagccagatcagcaccagacagatttgcacacagatgttggtgagccataacgacgcagaaggcgcgccttgcgcattttgtcgcgcgaagatgcccgggaaggatttataggctgccgccagaaacggcacctctgccgccatgatagtccagcttagataagccccgcagacagacacaatcagtcccgctgcaataataatttctccccacggccccatcattttcaccatcagaccggccatcgacgggttgcgcatctccgccagttccggacgcgcaagaacgccaagagaaagcagcgtgaccaggagatatattcccagcgctgcgagtaccgccagtagcgtggcgcggcctacatcgcgtttatttttcgctcgggccgagacgacgacggcgccttcaacgccaataaacacccacagcgtaataagcatggtgttcttgacctgttcccatacgggaataccgagctcaacaccggtgaagtccagtgtgaaggtatccagtttgaacatcatgatagccagcacaataaacgcgccgagcggtaacagtttcgccagagtcgcgaccagattgatgctggctgccgtttgtacgccgcgcaggatgaggaaatggacaatccagagcaggactgaagcgccgacaatagcctgccaggtattaccgtcgccaaacagacgcagggcaggcgtatcggtaaagaaactcagcgctgaaaagacgataaccaaataggatacgttggcgatgaccgcgcacagccaatagccccaggcagaacaaaagccaatcagttcgccgaagccttcgcgggcgtaagtaaagatgccgccgtcaagctcggagcgaatgcgcgtaaggattaacatggcgaatgccagtaggagtatccccacgccggtaatggcccagccaattaacaacgcagccggactggcaacggcggccatattctggggcagactgaaaacacctgcgccaagcattgagcttaaaaccagcgcggtcagcgcgctcagtcccagttttttttccattggtatccagctataaaaatgaaattggaagaataattattatggcaaaacgcataaaaatggtgaaagccactaaggcgcgggattttacggagagaagggaccgcatgcaacggcctggataagatttatcgccaaaaaagcgaaaagtgagattcatcgcgatatttgacggaactggcatcccgcgagaaagcctgattgatgcgccgcgcgataaacgtacctatttccgtgagataaattacatcgccgcggcatttcaatatcagaaaaagaattacaactcagcttgagtttgaagttcctctacagggtgataacgataaatcgtcgatataccgatatcgtaaataattgccaactgtttcctgctatagccatttttgatcagccttgctatttgttcatgttgctcttttgtcagtttcggacgacgtccaccaatacgcccctgtgcacgtgctgcttcaagtccggccagtgttcgttcaactattaattcacgctccatttccgctaaagcccccatgacgtgaaaaaagaaacgtcccatgggtgttgacgtatcaatgctgtctgtaagactacggaagttaacccctttttcccgcagttcctcaataagagtgatgaggtgtttcatgcttctgcccagcctgtccagcttccagacaacgagcgtatctccttctgataacgttctgagcagctttttcaatcccggtcgggctgactttgttccgctgattttatcctcaaaaatcagttcacatcctgcgcagttcagtgcgtttcgttgtaaatctgtattctggtcatttgttgacacacgaatgtagccaatttgcatgaaaaatatcctctttgttttgttaaaaatacatagctggtataggtgggagttaagacgaaaacgttggtttgggggaaggctctgcactgcccgttggtgtgcctgttccgtggccctcagccacaccgccagcagggtggctgaaatgtaacggagcagcattttcttctgaaatgtaccccaatctggcaaaggcttaccccgcgaataaattaccggatttacggggtgagtttattcgtggctgggatgacgagcgcgggattgatcctggtcgccagttgcttgagtggcagaaaggtactttggttggtggtagagatgacaatgatgccgcagttgatatttcatatatgagtaacggaaatagtattgattacggtggcgataaaacattttcaacgaattaccggagtgattatttatggtatgcaattctgggtaacgtcactggtcgtgccaaagctgctttaagtgggtccttttttaatgtaactcgtccacgcaacatcgcctttaactacattgtgagagcaacatagaaacgttggtttgggggaaggctctgcactgcccgttggtgtacctgttccgtggccctcagccacaccgccagcagggtggctgaaatgtaacggagcagcattttcttctgaaatgtaccccaaactggcaaaggcttaccccacgaataaattaccggatttacggggtgagtttattcgtggctgggatgacgggcggggaattgattcagggcgttccttgcttaatgcacaatcacattcggttatagatcatattcactatatggagttatggactggtgaagggcttgccgcaaatagcacccgtgcaggaacaaaccctggtatactggctacatacggtgatggcgggattgttaaaacagatgagtcaggtgtaaaagttccatcttcactacgtgctattggcactcgtggtgtttatagattaggtgccaacggagggaatacaggaacggaaaaccgcccccgtaatattgcgtttaactatattgtaagggctacttaatgaataatgctgctgcagtacttgatcagaatggtatcgctataactgcaggcgatattaccgtttataactacgatgctgaaaaccgtgaatatctctctgccactgttgagtatctcgcttatggtgttggaattccggctcactcatgcattgacgcgccaccagaaaaacgccccggcttcgctgtctgtcgtgataccgaccagaacatctggaaatatgttccagaccacagaggcgaaacggtttacagcacagagaatggtaacgctgtgcaaatcacacaaccgggagattaccctcctgatacgacggtgaaacagccagctactatctatgatgtctgggatggtgagacctgggtgacagatgcgggacgacagcacgcagcagaactggaagctgccggagcgcatcgtcagcaacttgaggaacaggcaatggcatctgttgagcttataaatctcaaactacgagccggacgccgattgacgccccaggagacggaaaaactaaacgccgtgcttgatttcatagatgtgcttaatgcgactgacatcagcactgcaccggatatcaactggccggaaatgcctctggcagcagccagttgaatataactaagccgccctcacgatatagttaaatgcaatattgcgggggcgggtttcactaccacctgtgttaccaatacttcctcgtgaatgaagcgttggtgatggaatcaaactccctcctgtatttgtggcatcaagccccctgccttgtgtatatgtttttttgaaaatcgtggccaactcccattcatcttttgtgtcatatccatcgttagctacaacaatatggcggtgtttttccaacatcccgttttgaatgctcaataaagcgcgtgccgcatcaattcctcgcccatcatcccagccacgaataaactcaccccgtaaatccggtaatttattcgcggggtaagcctttgccagtttggggtacatttcagaagaaaatgctgcgccgttacatttcagccatccctctggcagtgttgctgacggccacggaacaggtacaccaacgggcagtgcagagccttcccccaaaccaacgtttctatgccgcccttacgatgtaattaaacgcaatgttacgggggcgggtttcagttgcgccgacaatactggtacttagacccgttgctgttcgtttgttatttttattcccttcgatcagacagttgtaatcgtcattaccaattaacgaattggtggcatcaataccgtccggtgacaaggcattagttgtggaacttaaagtcagcatctcgtctgaacttggaagattttttaatgggatttcattgcgtgaaatacccgcataaaaaaaggactcatgcctgtgcgcttcaaaagagtcatcctgaagccttagcaaggctcgccccgcatccacgccacgtccgtcatcccagccacggataaattcaccccgtagatccggtagtttatttgtaggataagcctttgccagattggggtacatttcagaagaaaatgctgctccgttacatttcagccaccctgctggcggtgtggctgagggccacggaacaggcacaccaacgggcagtgccgagccttcccccaaaccaaggtttttgacaaacagcgcaggctcaggaatatctgcgccgttctggtctttagccagcttttccgccagcttgttcagtaccgtagtcgcaaagtttggatcattaccgagagcgtcagccagctctttaagcgtatccagtgtctcaggggcgctgcctgcaagtgccgcaagtgctttggccacaaactccgtcgtcgccagctttttgctgttatcaccatttgcaggtgtaggtgctgttggtgtgccggtgaatgtcggactggctttcgtcgcgtactgggtatgcgggtcaactgccgcgatatgtgcagccaggtctgttccgcttttttcgaccttctgtttgaggtatgacgttcggctggccagttgtttagcctggcggttagaaattccgtcaggtccgcccagaacggggtcagagacctcaatctggtagatgccgctttcccactgcggggtttcgggtagatttgccataattaactgctcccgtggttgtaactaccgtcataacgggtagtactgttgtatcgaatggcgacagactgatattccagacttgccagatgacagcgagccggagcaaaggcagcaagcgtctgacgtaacagcgccgcctgatcgttagtgatgggttgttgaaggatgacgcgatagactgcccaggcttgtgcatcaccatggacgaaaagcccgttgtacgtgtgtctgccgtcatagccaatctgccccgtaccttcaatcagatccacttcgccgaagccaaaacggcggataatttcccggattgaccacggtgttcctttatagcggtgtagctcgatagcggatttgataagcatgcggcgtacatcgtccgattccgccagttcccagccatcgccgaacagcgagaactgctcgccaagccatggcagcgcggaactgtcgacaatatcgacgagaccgaccatcagtacgctcaggtcgatgttatccagccgtccggccagtcttcccagcgttctgagactgatatcaccctcaagcggtggcgggagttgtagcacctcagccatcggacaccccggtcatgttaagagtgatcgctgtacagtttgcccattcgttttctgccaccaccctcagtgccggtgtcaccagttcgacctggtacaccccggaaacggacaacacgctgataatctggctgggaacaatatcgcgccccagcgtggcggtacgggatgccacccagttctgtatggcgctgttagcgttgtcctttaccaaccttgcatcctgatcacgatagatcgtaatcctggcttcaatggtgtaatccacctgaacaggtgttttagcccgcacggtatcagtgagtggtctgactttttcgtcagaacagaaactctctaccagagtgaggatactgctgtccggtagaccagtgctgagcagcggatacagctcgacagtgccgggagcgggagaaagaacagcaacgtcgacaatgccgggatgcgcccccatagcatgaaaacggtatgcaccacggcttccggcattggtgaatgactccggggccagcctgatacgctcccggagccggtcatcgtcttcctgctctgaaccgccagagctggccgtcagattggtcaccagcaggtcaatgttatcaatctcatcgagtaactgactgacctgcgccggttgccagccgttgccagcggtacccggctcggtacaggtggccgtgacattgaccagcagcaatccggccttcagcaccacatctgtatcggtggcaaaaataatactgtcggaagcgctgacgcgggtgcctgccgggatcagcacatcaatggccagtgcctcatccacagagaactgaagtgtggtggtggcaggctgcgcagcaaggcggtatacgtcgaccagttcaccgaggtaatcaatcatcggctcacgggaaaaagcgaccagattctgcttcgccgcctcctgtactgccaccctgaccagcatttcgcgataggcccacaggtcaatcagcagacgttcagcctgtgccgggtacagcgtttttccggtatccgcttcatacttcgcaatcatttctgccgtgattttatcggcatcgcgttcaataaaatcgggttctgtcagcgccatagcagttcctgagtacggggttgtccgtctgagcctttccagctcacccggagcgtaagatgttcgccgtcgacggcgggtttaaccgacataagctggcagcggggttcccagcgcctgatggcatcgacggattcgcgaaccacatgcggaatggcccggccgacaggccagtcgatataaaggtgcagattgctgccgaactccgggcgatgcgggtcgctgccgcggggagtccgcaggatgatctggatggactgccggatatcatccagcccccggacgatttcgccgggagcctgcagagctggttgccagaatactgaggtcgttttcatggaggcagtattgcccccgggaagtaagcgccgatattaaaggcgtttaagaaggttcaatgggaatggtgattagagttctgaccatcagcaaatatgttacccgttgcatgggcgcttccgttgatttccagatcaccattgagtgtcgcggggccgttgatcgtggtaactcccgtgaggtcgaggtttttccctttgagagagatatcagcggcaacctccaccacgatacgctcaatacctcctctgaccgtcagcgtatgggtcgcgcggttataactgaactccgcgccatcagcgtatttcgtaccccggacgtttttatcactgaacggcggtttatcgacgtctgagtacaccgcgcccagaataacaccatcctcgccgttggcatcgagcagcacctcaacctgctcccccacgtcagggagccagtaatccttgttatcctgggtattgcgctgtagcacgttaagccagtttgtgcgcagattatcgcattcaggcagacgaacgcgggcctgaaccctgtcggcatcaacggcactgaccgtaccgatctgacgggtgacaccagtcattttttcttctccttaatcaccgtcgatgtactgccatccgggtgataaaccgtgagtttctgagttttttgttttttccctcttgtgactggcccccgtgccacttccagctctgtggtgtagccgctgttacgctcaaacgcatggcgggcagtgattatcagccatggaccggataactgtccaaagcccaccagttcaattttgttgcctgctgtcagttgaggcgttcccgtcagcgtcagggagccgttctgctggtattcgttatgtctggccagtgctgaatccgctttaatccgggcgctgtccgggtcgctgacgcggctgttaactttaagtgagtcagcgctggtaaccttaccgcctttgagctttttgtcgctttcacgggtaccaccatcagcttcgtagacgatcagttttttactgctgcttttctggtgttttacctttgcagatttatagacccggttgatggtgtcacgcagggaaaagcgggccacaccctgcggttttaactgcctgaccggctcctgactgcgcagtgtggccagatgagaaaaaatcaactggtcactgaccactttcactgcataaccatactcgctggccagccggcgcagaaaacccacgtcggtttcagcatactgggtcacccggtcgattttgatggactcaatgctgcccaccagtttcagtcggtgctttctggcaatccgccccgcaacagctgccagcgtggtgttctcaaaaccacggctggatttagtccgcagagcactgttaaccgaggtggccaccccacggatagcgacaacggacgcgggcgaactcacttcgatctcgtctattgagaatgtaccgcaggacagcagtttctcgccctgataacccattttcagcgtcagcgtgtcacccttgcccggataccacttatccagccagcgaccatcggtgtcatccagctccacctcaatggtatcggactcatttttgatgttatcgctccagaccacacgggtgacataaggcgcgatatcagaggtgatgtttttctgcagataccacagagtgaataccggcgtcagcacatcgctgacgctggttaacgctgatgtggcttgcgcagtactgtttatctcagccatggggcaatatcctcttctgtacgggcatcttcagcctcaataaccgggatcagtaacaacaacccggagggcagcaccggcgtaatggccacgtgcggattggctgcaataatccggggatagcccagcgggtcaccgtagtactgccatgccagcgaatcccagcgctctccgtcacgggtaatatgttcaagaaacatcacacactcctcgtcagtattctggcggccattgcacttaatcccggagacatgcggttgaatgctgtgccggcggcgttaagctgcccggaaacggtatccagagcacctgcaatatttcttttgtccacaccactcagcgccgactgcgcctgctgtacatacgtggctgcctcactggctgttctggccagactgatggcatcgggcatggattcagagagtgcattaaacgccggaacacttttccccagagctccggatatattacccagtccgctcatcagtcccggcacacgggtcagcgcgacaacggggttacctttcattttctgcgccacccgaacggcactgatagtggtctggagtacagactgcgcctgtttcgcatagttgacgccgttacggacgaactgcgccaccccggaaggcgatggaacagcacccgatacagctccggcaccgggaacctgcctgcgtattgccggcggttgcagaggatttttcgggtcaccggtgtattcccggagagacacggtggcactgacagccagcacgttaccggtgctgtctgtctgctcgctggttgcggtcacatcggtaatcacgaaccagccgcgatagtcaccgttgccgaagaccagcgccagtgcctgatgggccttcatggctgttcgcactctcgccagctccacgtcgggcacacaataatgctgatggaagactaggcttatctggatttcgtccagcctgtcgccgacaaactgcaggccgggtttaccctcgatgcgggcatgctccgcataatcgacgccgaacgtggcctcgaagccgtcccagtaggtaatcagttcaaactcaatatcacccagtacggcaaacatcagctgtactccttacgttgtttctgagccagcagacgctccagcattttttccagctcatgcaggctcatattcagggcaccagtcagcccggcaggcgctgcggtttccttaccattgaggaaaaactgaggattaaagctgaccttgataccgccagacgctccaccgccagttgcagttgcgccacggcctgaatatccggcagccatgatttccggcgacgggatacggggaacatccggtgtcatttcagcggccaggcgctgcccggccagtgcagcaagcggagtggtccgttgcaggccaatggcggcaccctgcgcgatattgtcaccaaagcccataaacacgcgactcggtgaatggatgcccagcttttcgctgaaccagtcactgatgctgtcacccattccggttacgctggttttgagtgacgcccatttgtttctgatgccatttatcaacccgtcaataagatgaccaccgaagtcggtgaatttcgccggcagatcaacgccgagatatttcagcgcagccgcaaaggctttataaagcagaccagccggagaccagttaaccagcagtttaccaattcccacgatgccgccgttaaaggcttcctgaatgtcagcccagcgctgtttaaaccagctactgactgcgccccagttgcggtagataaggtaagctgctgccgcgacggcggtgataacgagaccgatgggattcatcagcagcgcccggccaatccagagaacggcacgcccggcgctcataattccgcgaaccagcccccctgagagcacaccacccagtgttctggctcctctggcgacagcaccaaagcctgtcaccagccagcggagtttaccgccttcccccagtgcgagcgtcagacgaagccagttggcccgaagtaaaacagcatttttccagacgcttacaaagggggaaagaaggagattcagcccaagcttgagaccgatagtggccatcctgaaagcgagtaatgcgcccacaacctttatggtgctgctgacgagctgcggatttgccgctatccatttgccaacactgtccattaaaggaataaatgtttcacccaactggagcaaagccggacgcaaggattgcccgatgctgatagcagaatcattaaagccgatctgcattctgcgccagcgaccttcaagcgtatcattctgctttgcagcatccttatccagggtagaaattgcagccggagcattcatttcctgcttactggaaaggtatttatcccagccctgtcgcattgacagtaaatggttgacagtctgaatatcggtaaagacctcagccagaccaaatgactccatgagtttctgctgaccttcctgatcgcctcttgctcctgcagctttccattgctgcaagaacgctttgcctttactgtcgataaaacggttggcaatcatcagtgaagcttcgtactgcgaaaaaccctgagcgacgtaattctgcattgacccctggtaatccaccccggctttagcatatttctggatggtatctccgcggcccattgctgccagccagttggacatattggtgaccgcttcctctgcagagccactacctttaccgacctccagactggcaacaatctgggtaatcgcatcttttccataaataccacgagcagcgaaggctttagccataccgggtaatgcttttgccatatccttcagctcaaatgacccaagtttggctcctgttgccgcaataccaaacgcctgttcaagttctttcgcatcagtgattctgagtgcatcgctgaaggcataagtcattttggcaaggtcggtcatatcggctttggttgctgtagcggtctttccaagcatctctgcaaacgttgctgcccgttcgggggccataccatcagcaactaattgtccgactccccctaacagagactcctgcagttggttaaccttcagcgaggcttgtctgatagcctggccaattgcacgttcctgttttgcatccaggtctcctgtgacactgatatcccgcaactgtgattcaaacgaggcatattgtttaaccgaggccatgaccggtgcgcccagcgttctgccaatagcataggtttctgcaccctgaccatagagcgccaggcggttagccttcaacgcatcaccggtggctgatactgctgacagacggcgctgctgacgttcaatttgctccatggtgcggcttacccgcagcaactcgctgttgagatgctgcatccgggaagaacccagttgaccataacgttctgttgcccgggttaaggcattctggcgttcctgcagacggcgggaggtatcaccaagggaatcaagggcgcgtcgggtgccactgacggctgagcggaagctgctcccgacaatgccgccaataatgacgccgactgaaaattcactggccacggtggctatcctctgaaagcaaaaaaaacggaagggaagtgtctgaaacccatgcagaacagccgcgactggcggctgttaagtgatacgttgttactgattgtcgccgaactcgcttttgatttgctcttcagcctgctccagccacatctccagatcgtcagtatcgagggcatcaatctcccccggttgaaacctgaaccatctcgccagcaggccctgcgcctgcatcagtgtttttgtcgctcttgcccagcccagtgattttctgaaatcgtttctgcagctccatatagtcggcaagatccatgttatcgaggtcttccgggaggataccggtgctacgggcaatcagtggttcgtcccagtctgccgggtctttgttgattttgcgcacctgcttcaggtcttttactgtcaggcgtttcagttcaatctgttcaattctggtacctgcagcagtggtgaaaggataagacagcgtaaaagtatcggactgggtctgtgacatgatcatactcctttgtaaattcagagcagtatgtctggcggtggacgtgacggatattaaaggggattaagaagaaggggccggagcccctgtgatgtcagcaagtgcgaaaacccttgcagttacgcaggaaagcgatgagaagcgcctttccctcagatttgccggtgccggagaaccactggtcgggcggcttccatgcttcaatcaaatcggccagtttgcgggcctttgaacgtgtgcagtcaatcgggtcattggttttacgggtattaaagagggtctccacccccggaatatcaaggagggtaaaccacgtaccatttgacatgcccagtgacgcacatcgccctcctttgtcagtcagttcaacactcaccgtcagcccccgatattgattcgatagtcagtcagttgatcaacgccaccgacgcggaagatgttggccagatagtccagttgcagcaactcttcaccatccagtacctgtctgatatacgtgcaggtgaagctactggagaactcggcgttctcgtgctgtttgaacgtccccagcgggttcttcttgaacataattgtcaggaaggtgaccagcgggatttcgtcgatcagcccctgcgagctgtagcgctggacgctggagcgacactgcagcgccagcgacttgtacgggttcgcggcagacaacatcgcatcgcggtaaaagctgttccatttgatttcgccttccagtttgtcaaaaccagccgggagttccaccttacccaccatccccagtgccttgtgctcctgcataatcatggagacatcggggagtttaacttcctcagcccgtcccagcaggttagtaccatccagatagatgttggcattcgtgattcggtttatctcaatctttgacatcagttgccccctttcagggttaacaggtattccgaggtgatttcagtctcaaacgtcagtcgctccagcggcggtggtggcgtatatttgtagctcagcaacaggtgcccggcggccagctccgtctccggattgcgggccggatcaaaccagcaacggaagcccagtaccgcaccatcaccagtcattttgcgaccgtaggcgttgaccgactccgtcagtgcatcaatcagcgcctgagtaatcggcatgtcgatgtactgctggctgaagtaacgaatggactcgttgatcacatcaccggtgcggcgaacgttctcaaagttacgcatatgggtgaccgttggccatgctgccgtccggttaccccacagatgaaggccgctgccgtaactgctgaataccgtggtgatcccctgttcgttaagcaggttcacctcgctctgcggatcgtcaatcattgccgacagctggcgctccacgccggtgatccccagaatttcctgattggaggatgaccaccagtaccctttgtccaggtcgactttggcacgcaggcccgccgcacgctggctcagtggctccagacgctccgtgttcgtcaccgggtcatataccttcacatgcgggtagcacaggcggacacggtcagagctggtattaaagttaatggtgccttccgggccacgtcccgccagagcctgcgcaaaagtggtaccaaccggcgcatcaatataggttactgctcccagtttctcagccatggcgataagctcaaccgagacgctgttctgggtgcagaataccggagcaatcaggattttggcgaagtagccaaacaggttaaaactgtcgttaagcagcttcatgccggtacggttgcctgcagcgttaacggtaccgatgatatcagccggggtgactttggtcggatcagcatagttatagctggccttcaccgttgcatctgcagcaatgcttttacccaggttagtaatcaccccggtctgtgcatcaagcgagtagtcctgaccttcaacataaggctgaccgttgctgtccggtttcagtaccagctgcgcgaccaccggattagccagccgggctctgcctgtcgccttgtcgaacgacacattctcactgaccacagcgattttatgcacagacggatcgagtacgttaatgaccagaacggtgcctgcaccatggtcataaatcgcatccagcgcctgcggaatggtaaagccggtgaactggctgccaaatgccgcagcgtctttctcagacaggcactgtaccagcgtattgacatcccccatcggggcggtaccaatcaggccaataacggcagatttcaccgttttaaccgggcgggctccgttttccacctcaatggtttcgacgccatgcagatagttagctgccatgggagtcctccgttttcacttcgctgtcactgctgcttctgcgctttggtgactgcacagccggtgtgacggcgggtttagtatcttctggtaccggcgtcagatgcttcagcgccaccagtaccttcacgtagtcatgctcctccggcagggaaaccgtcttccccggccagagcaggatttcggttccgtccgacagcgtgacgccgctggccgggccggaatagcggtattctttcatcactcgctttcctcatagttcacttcggttaacagcgggccggacggtaaatcgctgtcttcgataaagacgctttcagtcgcgaagtcgagggcgtattgccacagccccctgacttcaccgataaacacctcgcgggtcagccagatacggcggcggcagccgggcggggtgtggccgccgagaatgcggcggacagcatccaggacattaatcgccccttttttaccgttgagctggcggaagaccaccgtgacgcagagctggatagtctgagactggatcaccgcaccggtatcatccggcctgtcaaagcgcgaaccggcatagctcagcagcaacgcgccaaccggatggttcaggcgatattcagccggtttctccgggaagtactccacctgcagttgcggcagcttctcgcgtaaccgggccagtaccgcatcaaggacgggcagaacgttcatcagtatttctccagtaaaccgtcacgaccgccgaaagtggccgggcggctgcgtacacgaaactcgccaggctcaggcacatctttctgagtggacggcagccccagcgtgagcctgttatcacgtaactccctgagttgccgcagcgcttctttgtggtcatccttcaccgtatccgggaggtcaccttccgggcggcgggcgtagagccggtaacggaccagcgtgatggcaatgtcccgcagaacagtcggtatctctgccagtggcaggatatagcgtccgcgcagatgggcatcaatcagctcgtcggcatagcggatacagctgtccaccacacgggtattcactgttgcaggcgagtcgaagtccatctcttcactggtgagctcgatcagcgttcgttccggcacctgcgcaagcaaatcctccagggtgcagtacatgtcacaccccgcgcaggatacgaatgacgtcgccttcacccccggcttcatcaagtgcaataccacaggatttaccgtcgccggactgcggcacggctctggcctgagcatctgactgaacagccacaccacggctgacagcggccccggcctcgacagcaataatgcccagaacgctcaccggcgtgctgtcgccggtaacagcatccacttcggcaaccccgagcgctgcggcaccggctttacagggggtattatctgccccgacaaaacgctgctgtgccagtgcggcccctgccgttacggttgtgatcagaatgacctgctgagtggttcccataacgcctccttatttactgataccggtaatgagatacccggcatcgccaccaaccacggcgactttgtagatatcggtataacggcagtacttcaccttgccgccggctccgtcgtacttgtcggcaacaggcatccccttacggcgcagggtgtagccgaaggacggctcgttctcgtccgcgctgtccgcccccggctgcggcttgccgacgtaatgcagcatcagattgtctccccagatatccgtcggcacgctgtccttatccattgccgctttcatggacggcagggagacaggagcaccgatgacgatctcttcgatctgaaagaggtcctgcaggatctccgtggtgatgcgcttgcgttcgttggctccgatggctgcctgaattgccgggtggaacttcagcagcgccatcacgccggcccccatggtcatcaggttaggacgcagccccgtggccgtacggaccgcttccataccggcttcaattaccccgatggggtcccccttaccaccggcccagcggtcgccggctgtcagttttttaacgtgcccggtacggtagaccttttcatcctgagccagacgggcggcgataagttcacggcgcagattcacgccattcgtggcgcgacggatggccttgctctcctcgttaaacatggactccgcctgttcgcgatagtccactggcgcagccagatcgtgctcacccagcaccagatcaagcgtgccggttttctcacggaccagaacattgctgtccgccccgacggcacgctcggtgtcatattccacaaaggcggttttcccgaaggtcggcacacgcacgccttccttgtccgtcagcacgacggggaaaatacgttcgccaatgaatgcggcatttttatagcctcgggcgatactggtcagtaccggatcaacgacacgtttaccttttaagtaatcagacatgctctctccttaaattacaggcagcgtgcgacagcagcctcatagctgatgccttcttttttggacagggccactgctttctgatgcagggccagacgctcaggatcggcttccgcaaactccgccacatccaccttcaccgcgtcgccgacacgatcctttgtggcctgttcggcgaagttcatcaccggctccccgtcggagagcaatgaacggaaggcggtggccagcggtgtgcggctttccccctcagcaaactccaccggcttgtcgccaccggcgacggcatccagcagggcaaccaccacggaggaggcgcggggagccagacgcccctctgcgaccagtttttctgcaaaggccacattgtccttatgcagttgctcctgtctgacctgtgcatcacgcgcatcgcgatcagcagcctgctgcttcaggcggcggttctcctcctgaagggcttcaatctcttcttttgtcatcgatgattcctcgttacttgcggaagacggccccgggcctgtctcactgaattgtgcacctgctgcatcctgcgacagtgtgtcgcggtacgcctcttcgcgcagactgttgagctgccattccggcaggactttttctgcctcgtccagactgaagcgggcgatcagaaaatcgcgcagctttccccacagggaggcattcgtgatggcctgccagtcggcgaactccaccacaccttcttcctgctcactgaaggacacctgtttcagccctttgacggaaggtggctgtgccccgagaaagcccacatggcgaaggtagagcacgccgggcttcggattggacggtgaatccgggaggtagaaagaggcggacacttttttgaatcgtccgtcggtgaccatctcagcaaactgcgggtccagctgggcaggctctgccatcagatcgacgccgctgagcgacagggctttcacccagccccacgccgggtcttccgttctgggatgaccaatcacgagtggtgcttcatggacggacgggtcataggctttcacgcaggcggcaagatcgtctggcgtgaacggcagttttttgccgtgcatatcggtatgagtaccggctttaaaaatgtgaatggctgacattttgctgtcccgcgttatgttgtcggagacagtttgtgagaaatgcaggcccggcgattttaatctgctttagaaaacatcaggggagaaggacagggaaagcaatgcggtgaaccggaggcggttataaaacagaggctgtaaagcctttataaaggtaatacagcccctcattcgctggcaatgataaatcacccacctgaagagagaaaactcagcgacgggccgctgattcaagatggcggacaatggtatcgaggatggggattaccacttcaggctgtagttctccatcccccgtcaccggcaggaacgggcgggccggaagttcaacagactcattacgccccgttttacccccgaactggtgaatggcaccgtaaacaacgttggtccccacaacagcctgccggtcgtcatggtcggttgatactgaccccatcagacgcccggtatcctgcagtgtctgcccgtcacgttcttccgctgccagcgagggcatccaccccggacgcccctcatcaagaaagttaaactgtgtttccgccagcagggttccggcgattttgcgcatcgcgggctccatgtctgtggcagccagatccagcgcacggaggctccggcgcagggatttatcgttaatggtgatactgaccaggttatcggaagccattgttatcctctcagttcctgttgtgccagtggctgaagcgtaccttgatagcgggccaggtcgggacggtatgctgcccccggtgcataagaccagccgacgtcggtggtcaccttcgtggtgccggtattaaaggtggccacgttccgcatttcgccggttttctctgagaccagtttcagttcctggcccatggcagagccggagctgataaccttcaggccacgggcacgtacatccgtcgcactcagggcaatcacactacagcggcagcgccagccgttcggcgggtaaaatgcctgccagaacgggtcatcccagcgcagcaccagaccatgcagcgccagatggctcctgcgggtatggctgtcgttgatgccggtatacatccagtacggcctgtcgtcgacgttttccatctgttccgcccaacgaccggcgctgtagagtacggacatattggtgcgaaagatggtatcgagccgccacggactgccctgctgaatggtgaccggcttacccgttaccgggtcagtcgtgtcacgtggtccccaccatcccttacgcttcagcaccggctccagctcctgccggaaccagcgatcggtttttccttcatcgacagcctgctgcagtgccccgcgaatatcttccaggatatccaggcgggtcactttagcaacggtaaaggcgcgggcatgggcctcctgccacatttcttcccagtcccaggtaatctgataccctttggacttcaggtaactgactgcccgcttcgggggaagcgtcatgcagtacgccagttcagccgttgtcacgctcatgcaggcgtccccagatatttgccacaaagagaatgcgggccagccgttcctgcagatcgtccgtgttcatctgagggtagagctccgccagttcgcccagcagctcagtcgggttaaccccgttttcgacccgcttaaacagaggtgccaggacgggttccagcgtgccatttaacacacctccgttcatcagaatgtccagcgcgtcgtcaagctgctgctgagcctgaatatcggcatcaatcgcctcggcaaatgacagcggcagcatgttattctggcgttccgacggtggtgtctcgtcaatatcgccgtcctgcagctggtactcacgcttaaagtattgcggggtcagacgcagacccgcccgggtgagtttttcgtcgcgggtggcgcgggtgtcatcaatggtctcctgttcccacatggcccagaccggacacggcacatcgccgaagttcagggtgaccaccgttctgataacctgattcactgctgcctgaatgatgtccgcatccgcatcgcggatatcagccgttacctccagcccggcctgtgctgaggccttgttactgttcgcttccgtggtctgattctgaccaagtaatgcaatggagatctcactgcgtgacagtgtgatcagctcgcggaatacctcgctgctgtccgccttaccatccgcggctttgagttcgatgctgctgtcatcggggatggcggccaccgcgtcctccaccatctgctccatggagtccagcagtttttcaatctctgcatcatttgcacccctcgggtgcttaccgatcacccacggggagccaaacttttcggcaaagcggagccagaatttcatcccgcctttcttgaaggcgaccggccagaagcacatggacaggtccgggaaaccgtaaggattgtcatacgaggcatcctgtgccggcaccacgaattttgacggtgacagcagctcaccctccacacccgcatcacgcgcccggaagcgcaggcagttgtccgtatcaaactgaaaccactcaggcggtttgccgacaatatccgtcactgcccacgccctgaccgaacggccccacatgatttcacagggctgatacccgtagagcacggcatcactcatctcaccgatgatgcgggacagatccagatcgtcgagcatgtcgcggatgaaacggaagacccgggcagaagcgtgaccgcgctccagtccacgctccagtgatttgagcgctgctttacgtctgcggatacagcccccaaccagcgggtcggtgcgcagttcgcggtagatacggatatcccgtccctgagccttgagaatgggatcaggattgggcagatacatgcccagtccgtaaaagtcgatcgcgcggctgcgggaggcaatctgcgcggtcagtgatttctgaggctcagaaaaagcaacaaattcatcgggtgaaacccagatacccctcgccatcagaatccctccagcatacgggccgcctgacgacgacagcgtgagcttgccttcaccggccctttgttaatttcacggctggcgaaatacgccagcgccagtgcgatggctgaatccccgtggcgtttaccaccgtcagcctttgcttttgagcgttgctccggcacgcgggggacaccgttcaccacctgaacggcccgcaggtcatccagtgtgtcttcatcctttggtaagtccaccaggttaccgtcttccagtgcagctttgaccggaggcatatgctcccggtaccagccttcagttggcatcacctgctgaacccggctggagccgtagcgctgcatggcgtattcagccagataggcaccattaccacgggcatcaaacgctgcacccagcagaccgggcaggccatccatcagataccaggtgatttgctcctgctgtctgaacggcacgttacgcagctccagtacgaatggcacgcgtcgtaccaggttcttctcctgcagcaggggatagtccaccgacaaatcaccgctacggccaaagtcgcgccccaggaaagagcgggcatcagcggggagtgcctccagcaagggtttcagatgctcatcaagccagtcctgtgtctcgtggaagcgaacctcatcagacagcagttcataaccttcctgacaggtcagacgcaataccggcgtatcagcggacatgcgggactctatcagggcacgggacagccaggcgccgccaccgttggccggaatacagtcaagctcttcggatgcgccggcagcgtagaatttgtacaccgacgccatccaggcctgctcggatgcctctgaccattccttcccggtgcgcagacaaacgcgccggaacagcccctcagatacggcttcccggaaagtgatgcgatgtacgctgcctccctgacgtccggcacggatatccccgataagcgtattgaacggattgtcgtcaccgtcatgggtggagataacgcgtacctttcccccccagataagcatcgccagcgccgctttcagcagttcgtccagttgctcatggaacgccgcttcgtcgataacaataataccctgacggccacgcaggttagacgggcggctggagagcgcaacaatacgaaagccggagtcaggaaatttgatggtgtaagtcttgatgtgtttgtcgtcgtcgtcctcttcccagaatccttcttcaatttcactggccgcatagttgaatgcccgtgcccacattgcacacgcctgaatgtattcgacggtcatgtcctggttataagcgatgtaatacacattcatcccgcctgctggcgcagaagaggcggcggtcagtacgttatcggatgcctcagcccatgtaataccggtacgacggctcttttctatcaccttaagcggagaggtgtctgccacccagcgctgctggtaaggcaacagaacgggaggggcatccagcgccgaggtatcaggcaaaacgggagcaaggttattcctcccgtccatgggactcatcccttcggggccgccgccagcggcgtttaaaatcactccggatgattttgtcatgtggcaatccccagaatctcgcgacgaagcgcctgtactgcgtcgcttgacagtccccccttacgggcaattttctcggcgttgctggctgcctgctgcgctctggcccgtacttcagactggaactttttgaggttgacggacgcgcgggacagcgtagccacattcttcgccaccttcgacagcagggccacgcgttctttaggatcgacttcgccttcttccgcctcctgcaactggacaatactctcgaacagctcggtctgaataagggctatcacagcctccgaacgcgcatcctgatcgtctgctgcgccttcggtcagcatgcgggccgcttctgttgccgcacggatagcaccatagcggcgctcaatcttctgtccatagcgatggatagcggatttgctgataacgtacccccgctcacgcagcagggactccagctcgttatacccgctgaagccggattcagtcagcgcccgttcaagccagcggcgcacgtcttccggcagcttttctattgtgctgcgtctggccattattcactccagtacttttccgggcgggcaatacccggaccacatttcacggtgtattccaccaggtctacgccgaggcgggtcaggtcagcaaaccagtcgccagaaggttttttctccagatcaaccattttacggtcagccagataatccagttcgcggcgcagttccagcggtgtggtgtccgggtagatggcacgggacacatccagcagcagcgtctcgctggcggtgtaagggcgggtcttgttcagggcaaccagcagactccagcgcagggattcgcggcgtacccgggtaatatcgaccattattgacctccggtattgcggtactgctgtaccacttccagtttgttataaagcgcgtccagtttggcctcaatgactgtctggccacggatataatcctctcgacggacataattcagcggtaaatccgctttaaatcgcataaattctttttccagctcgccccagttggaggcggattgttgcagggcctgttcaagggaggcgaatcgtgccgcctggcgttcttctgttttactgaacaaccatttggcgagccctcccacaaaccccatgaaggtgagcagaaaactcactaccgtccagaattcaacctgcagtgtcatttctgtaatccttcccgttcatccagtaacgcgtttatctggttccgccagcgacgacattgtcctgcgttgtcgatgatgttggcgagaacgtcacgctgggagacacccgaatcgcgtaaccgggtgtcagtggtttcaggttgcccggtcgctgtgccagagcgggtgccagcggcggcaactgagtctgaatgaccggtgtcgacggatgcattgtcatatccgagtgcggcgttgtactggcgcacgaaaccgcgagtaaacacgcactcaatgggatggctcttacctttttcatcaatccagcgctgtgtgacatcgttaatttgcccctgtagttgtttattccggctctccagttgagcaatctgctcaagataaccggcttcagcccgctgcccggcggccacctgctcctgataccgtctggcccaggcccgcagcgcagcattctcaagcgttgcctgctccgttttgtacgcgtcaaatgctgactgcaactgactgagcgcggtatcaccgtcacgctttgcagagtcatgaccacttctgtatcccatggcatacaggccgaccagaaaggcattgataagaatggccagcagaatgccgcgccacggcagctttttaaccagatgccacacaactgcagcctccccatgtgagatatcgcggtgccagttcgcgcaggatgcgctgcggataatggcggttctcccgccagctggccgcattgcgtccggcattcaccgtggcgacatgtccgaaccagcgggtgctgtccagacctttctgtgatgcaagccgcctgtcccgttgtacccagcccagaccaccgttatagcccgacaatgtcatggccatacgctcgcagtcgttggcggcgctgacgcgctgccacagccagcggtcatagctgaccagcgcccggatagcccatgcaggattaaacggctcacgattgctcagcatcggtatcaactggcttatccagtcggcagtggcaggcatgaactgcgccagtccctgagcgccagccggcgagaccacatcaggtcgccagccgctttcctgatgcagttgcgcggcgaaatcggccaccggcgcagacagtccccattcaagccgggcattacggatcacatcatcgcgatactgcagcgcagcctgcggaggctgcgctgcgcgggcctgactgaagaagccgccacaccagagcagccagacaatcaccaggttgccagcaagctgccaccagaagctgtatttatcgttacgtggttctccgtgtctgatggcggttacgcccagaccaaaggcgaacagaataatgagggtgatttgaggccagttcatggtcacagtcctgttgccacagccagacagaccgctgcaacaatcagtgcacggcggattaacgcagcagaaaatacaaggtgaaggccggtctgcacagggaaacgcccttcagccatcagtctgtcgtcatgtttcaggtactgaccgggacgggctttggggaagagcgaacggtcaagccagtaacccagcactgctgccagcgtgatgagtgccagcttgtagatcacaacaggcaactgctgtggcgagaccagagcgatgatgcccagcaacagcactgaggtcagcagccagccgctgaggcgaggttttttaacagggggaatgaattttttcaggtttttcatgtgtgtctcctcgtttggtggagacagcatcacaaatgtggcgggatacggattttaaacagcgttaatagtgaagatgtaaacgtgcactgcatgatggctttgaaagaacgaccagcccggtacccgaacaccgggctggccatcgccccacaggaatgcgctgtgagccgacacgaaacccctcttggaattccatacgacgatacagagctgtcagcatctcaaatgaaatcgccacgattaaacctcagtcatccacatttccctaaattcttcaggtacattacgtagggtgataatatttgtttccggatcataatcaatatagccttcagttttcccttcccggtcaaacttaagttcccaatatttagacttgcctttaaaagataccagagcccgaatgactcgaccatcaggaacgaagccatccgataactccaactcttcagcagcaagtttaccagataactcctcgggagcctggggccaaatggcattaacaagggtttcaagactaagtggttcaccagccttacttagtgcatgtaagtgttcaaacgcactcttaagaaatgcatctttttcagcgccgtcaagtcctttctctgccgcaaatgcttttaaaacgtcacgtaacttttcagactctcgtttggcgattaagacatcattacagcctaggaactgtgtgcgtcctgcatattttgcacaaatatcgtttataaggcgctgagaggcttcagtaactagaccttcttcaggactcaatctctcagaagcgtctccatttgaaagtgagttggggctggcataccggacatctgtgagaatgatgcaagcatcgacaaaatacttatccccggcgctgaaaccaaatgtgccaacgttggcacatttgggaaaagccaaacttttcgaattaatgacagaagacgacgaagagcttgccgaactggccgacggcggcacagttgccggcctgacgcttgacgacgttgatcgcatgtcagtacgcgaacttcgccaggccctgcgcgaagcgcgcgaaaccaacgcagcacaacagcgcgtactcgccgataaaaatgaaaaaattgattctctctctaccagactggaaaagaaatcccgtattcagccgcctgagcctgatgaggaggttaagaagctgcgggcggaagtgacagcattagcggttgaggcggaatctgctatcgccgttcgactgtccagcgcttttgagacactgtgcgcatattgagctgaaaacatgattgatacccccagagacttcatggcaggcctggtctgtcaactggaaagcacagcgcgtagcctgcgctccacatttgacctgccggacgagccaacaggcaatgcagcgccttcatggctgactgagccgacgccacagattaacgggctggaggcataaccaatgaatgctgccctgactgaacgactggtttatgtcgcccgcgcggcacgtgacgcggggcatggtaaacgcggtgcaatatacgacgctgcctgtgctgaacttggcatgtcccgcgccactctgctgcgcaggctgaaggaggtctctgtgactgataaacgcaaaaaacgcgccgatgccgggcgcagcgccctgacccgcgacgaagccgcgctgatatctgccacactgcgtgaggccacccgcaagaacggtaagcgtctctattccatcgcggatgcagtggaaaccctgcgggctaacggctttatctccgcaggcagaacagatgaaaccaccggtgagtttttcccgttgtccgaagatgccatcagccgtgccctgcgtaactatggcctgcacccggaacaactggatgcccctgcaccatatactgaagtggccagtctgcatcccaatcatgtctggcagattgatgcctcgctctgcacgctttactacctgagcaatggacataaagggctgcaggtgatggacagcgcgaagttctacaagaacaagcccgctaaccttgcccgtatcgccagtgaccgcgtgtggagttacgagattaccgaccatgccagcggctggatttacgttgagtatgtgacgggggcggaatccggtgagaacctgtgttctgtgcttatcaacgccatgcaggagcgtggcggcgcagacgtgttgcacggtgtgccgaaaatactctatctcgaccccggctcggcaaacaccgcgggtatgacgaaaaacatgtgtcgctcactgggcattgacctgatagcgcacaagccgcataacgcccgcgccaccggacaggtggaaaaggcgcgtgacattatcgaacgcaagctggagccgggtctgaagttccggccggttcacagtctggaagaactcaacgcgctggccgcgaaatggcgcagccactttaacgccacggctgttcacagccgccacggtaaaacccgcacggatatctggctgaagattactgctgagcagctgaaaaaagcgccttccgttgaggtatgtcgtgaactggctgtggcggcaccagaactccgcaaagtcacgccaaaacttcgtgtctcgttccggggcactgaatttgacgtatcaacggtaccgggcgtactggtcggtgaaaaactgatgattacccgtaacccgtggcgcagcgatgtggcacaggtggttctgaccggtgaggacggccacgagacgttcttcctggtcgaagaggtcagaaagaacgagtttggctttgctgaaggcgcggcggtatttggcgaaagttacaaagccctgccggaaaccccggcgcagatggcggcaaaagaaaccgaagcgctggtcaccggtacagacaacgccgcagatgcagctgccgcacgcaaggcgaaggcgctgccgttcggcgggcggcttgacccgtataaacatattgatgacgccacacttccggcctgtataccgaagcgaggtcaggcctctgacgtacgcggaccgcgcactgaacagcgtcccatgactcatgtggaggccgcgaaagccctgcgcgggaagttcagcgccaacggccttacctggacgccggaacattaccgccagttaacggcacagtatccggacggcgtaccggaagccgcactggatgaagtcatggctacgctgaccacgccggcccgcagcagcgttatcagcattgttaacggcaactgaggagggaaacatgctggtactgaagcagcaactgaaagaggcccgtattccacaggcggtggtggcgagagctgtcgatgtttctgaggccacgctggcccagattgtgaatcataacgcgtggccccgcaccagccccggagaagtgcgccggcgtcttgcgtcctggctggaaagtcaggggattgatacagcgaagagttttgatgctgtacagggcgcggccacgccccgtacagcgggtaccacagataaaacgagcctcagtgaggaagagaatatgttactcaaaaaacaggtgttatttccagcaaccaaaaaagcgtttggtcttttccgtgacccgttcgccgacgaagccatgcagggttctgatgatgtgttcaccacaccagacattcgctacgtgcgtgaggcgttgtaccagacagcccgtcatggtgggtttatggccgtcatcggtgagtccggtgcgggtaaatccacgctgcgccgtgacctgactgaacgtatcaaccgcgagaatgcgccagtgattgttatcgagccatacatcatcgctatggaagacaacgatgtgaaagggaaaactctgaaggcagcagcgattgccgaagccattatcagtaccatcgcaccactggaaagcatcagacgcagtcaggacgcccgctttcgccagttgcatcgcgtcctgaaagacagcaaccaggcggggttcagccacgttctggtgattgaggaggctcacagtttgcccattccgacactgaaacacctcaaacgcttttttgagctggagtccggtttcaaaaagctgctgtccatcgtgctgattggccagccggaactggcgacaaaactctctgaacgcaacatggaagtccgcgaagtcgttcagcgctgtgaggtggtcgaacttctgcctctggacaatcaccttgaagaatttctgacgttcaaactgcaacgggccggtaaacaactgacggacattatggacgccagcgcagtggatgccatacgtacccgcctgagcaatccgggaagtcatcgtaaaaatatggtcagcctgctgtatccgctggccgtcagtaacctggtaatagccgccatgaatctggccgctgaaatcggggttccacaggtcaacgctgacgttgtcaaaggggtttaataatgaaatccaccacaggtatcaaccagcaaatcagtaaagtgcagtcagccattatggcgcttaaggcgacgaacacggatgtacaaagcatcaccatcaggggtaacaaacctgtcatccgcgtttccaggagtgcgcattgcatgcgcatgcttgagcagggaaaggcctgttatctgtataccggacatgaccacaggggatatttccgtcagggcgttttcgaactgcacggctgtcgcgtcgtgtggccggaatctttgtggtaatcagcacaactggagaaatcataaaaaatggcaaaaagtacaaaaggtgcaaaacgtatcaaggccgcagcagcactctgggtgccggggacacgtgaagaggtcattgagggcatcagactgctcggtgacgcacaccgtgaactggtcagggctgaaacagaaatgaatgacgccattggcgatatcaccgcacgttatgccccgctcaccgagagcctgaaaaaacgcatggccgaactgcagtccggtattcagacatggtgtgaggcacaccgtgatgaactgaccggcaacgggaaggtgaagtttgctaacctcaccaccggcgaggtgcagtggcgaaaccgcccgccgtcagtcagcattcgcggagcggataatgttattgaactactgagacgtctggggcttgagcgctttattcgtgtaaaagaggaaataaataaagacgctatcctgaatgaaaaagaggccgtgaaaaatattcccggtatttccattaaaagcgacattgaggatttttcaataattccttttgagcaggatgtgcagtaaacacaccacgttaattatttaataaaaacattttcttttttattccggcgtcagcgccgtgggcttctgcacgctggaaacagaggagaattaaattatgatatttaaatgtattcagtgcgagagggatataacagccctgcgttttcacagcgccatcgccgtgatgtccggtaaataccacatccctgcggtacgcgtcaccctggtctgcccgtactgcagccagcatttttcggcagacgtgcctgtcatggaattctcccgccctgacagggaggacgcgcaatgattaccccacaggaagcacgccagcgtacccgcgcccttgttgaacactatgtcaacgagtgtgaatgccgcgacctcaccgatgtgaagcacgtcctgacggcgctaatcagcatggccacgcaggccattgtggcgaccaacggaaaggcggctgcactgcaggtactggtgaacacactcacccacacggcagagaacgaggtgccgtaccggatggaaaccactgcagaaggcggcctgcacatcaccgtcagccggaagcactgagggcgcggcatgacacggaacaccgaactcacccgcaccgccctctaccgtctggccctgcagcgtttcgggccggacgcacaggccctgaaactgacagaagaggccgctgaactggcggccagtgccgcccgcaacctgaacggacagggcagcgaaagtgacctcgcggcagagctggcagacgtggaaatcatgacagagcagctgcgccttcagggaatggaccggctgattgacttccacaaacagaaaaaactggaacgccttgccgcacggctgggcgtcacatacaccggagaaatcatatgaaccgcaccgaacagacgccacaactgacgccggaagatgctgcacagcgtattcgggtactggaagacgaaaacgaatacctgcgcaagagatttgaagaggtggacctgtacttcgggcgcaatctggtcgtcatgaaagctgcagtgattgagtggcgggccaccggtgatgccaggaacggcatggcgtggatttacaacaccctgtgtgggccgggcgaactgccgccgcaagaggagaaagaggcacaggaatacttcaacagggaaactgaagttatcgacagaaaactggctgccctgtaccactggttcaggaaataccacaggacacacgccgcacctgaccagaccaccacaggaggtaccagtgactgacaccattatggaaattgtggtatgggctttcctgcttactggtatagccgtgtgcatctgcgccggattcgccctggttgccctgctgacccacgtggtgacgcagtggttatgggaaaagcttaaagcagcatacagcctgaaagagctgtccgacgctgttcgggcatgggaacagcaaaaaaataccggagatactgaacaatgacagaccaggataagcacattgagaaactgaaaaagttgctggcgctggcagcatccggcaacccgcatgaggctgctctggcactgcgccgcgcccgtaaactgatggatgttcacggcatcacacattccgacatcgccatgagtgatattgatgaaaccatcagtcactactggccgacaggcagcctccgtccgccgcgctacatgctgggcctgatgaacatcatccgcgaggcatttggtgttaactccatcattcaccccggcacatatccgggtgtggggttctacggcaaccgggaacgggccgcactggccgcgtacacctgggaagtgctggcccgtcagctgaaaaaggcgcgtcagcagtatatcagtgcacagaacaaaagaataaaaaccgccacccgcaccagccgtggagaccagtttgctgaaggctgggtgctggccgttatcagtgaaatacagtccttcgccctgaccgatgacgaacgtgaactgatgcagcagtggctggaacataaatacccgcagacgcaaaccaccagggcgcgtaaaccgggaagaagtcgcaatggcgacgcctcgcgctatgcggggtttcgagaagggcagaacgtcagactgcaccgaccggtcagtgggcgggaacagcagaaactggaggccagatgattacgttatcaggtaacagccggaaattaaaagcctgccgaatatctgccagatacctttttgcccgcgccttttttaagaacgtcaggccggggatcacaattggtgttattgccggacgcgaacaggttgaaaaatacatgtcaggtgcatggtggaataaagaccctgtcattgctgcccgtaatattcatatcagttggggggatattcagaatgacgactgaatctgttgtatgtgccctgttctggtattgttttgtcggttggtgtactgctgaactgcaccgccgttcagggttttattcacgttacagtggtgccggttactggattagctggtcggtgatgttcctgtgctggcctgtggcacttcctttatatgtcgattatatcggtgatgcaggcagaaggagcaacaatgatgactaaacaacgtcttatccagctcattcatattgcccgtaatgaactgggtatggatgaagacacctaccgccagatgttacaggggctgaccggtaaagcctcaaccaaaggaatggataccacacaactaaactgcgtgctggaatccatgaaaaggaaaggctttcgcgttaggcctgcaggaaaagccagctccggtttaccgctggataaccatccgcaatccaggaaaatccgtgcgctatggcttgaaatggctgctgccggcattgttcgtgaccgttcagaaaatgcattagcgcggtggatcaagcgggaaacgggcatcagcgccctgcgctggctcaatactgaacaggcaagcagtgttattgagaaactgaagaagtggcagcgcagagctgcgggagtaaaacatgagcgacctgaatcagtttcgaagtaaagggccggaactcctggtggaactggcacagcatacctctgagaccgttcgcgagattattgatattgagcccgcaattgccgaccagattggtcaggccgtcgcgaaccgcatgatgcaggtctggggcgggcaaaacgtttatttcccgatgggcatggtatggaaggtcagtcagcgcgaccgggaaatcttcagggagtttaacggacgtaaccaccatgaactggcccgcaaatttggtgtttcgcttcagtgggtctacagcgtggttaagcgggtaagaaaagaagaactggatcggatgcagggcaagctatttgctgatgaacccgatgtagatacggagaaaaaagagtaatatctgcaatcaggctggcgcgagttctgtttttgttcgggccggtctgattttcacatactgtaaggttattgcatattcctcctggtctcttcccattttgacccagttcttcccataaatatctcacttattccctgtcatttatctcaagtctaatcacctgatggcgacgcgcgccttatttatagaggtcggcgctgatggtgatgttattaccgcgctcctgccactgacgcgtaatatgataatacttagcgcctttcttcgccgcgcgtttggcgacctggtaggagatttctgtcatattgccgtagttgccggtgaacttaacgctgtcgaaaggcaccatcatcgcagccgtcgctttattcagctcctcaacttttgtgccatccggaagtgtgacagtgtaacgcccgcctttggaggattgcgtttcgaagaaacggcctacttcggcgctcggcgaggctgacgtggcgacgcctggaatttcgactttcttcgcagcttcgccgccctgagccagcgcggcacggccagcttcagagtctgccggaatagcgtccgggctctggacgatgcgttttttcgcatcttgtttatagataaatacagtgatgcgttggtttccgccctgattcgcatctatctgacgaacaatatagaaagcgtatgcgcctttttgtttcgccgctttcgtaatggcatcgttaacttccggctggctacggtagaagccctgaacggtgacggtgtcatacggttctaattgtacggcctggtctttcggtaattccacgatgccattaatgacacgatttttgggcgcgtcggctttcggcgcgtcggctttatacacgtccgccacaacacgccagttaccactgttgccgaactccgaggtgtcgacaacatagaaggaggctgcgccttctttatctgcgcggcgggacacggcggagaccgcatcgccaatagcattaaaacgaccggtaataacgatgcggtcataaggttttagtgcagccgcttgctccggcgtcagttctgttgctgcatggacagaaaaagcagccgcagaaagcagagccgacgccaggagagtgttcttaagcttcataaaaataatcctttgccttgcgcaaaccaggtactggtattgttattgactagaaacgtggctgattattgcatttaaaccatatggatgtctgcgggatttttcacgcatcgtgtcatgtatcctatctttgatgataacatttactgatatgtcgaaaaaaacggcgtccgggcggctaagctaatgaagcgcataaatttaataagttaatttaatgttaatttcttgatctcgccaggggtttaatgatgttttgctgtcaaatttgagcgaattatcagccctcgcaggccattttcaaggcattatggctgcttagcggctgaatcgttcatgttttgtaaatttgataaaaaattctgttttttggcgctagatcacaggcgttattttcagtaggttatagagagtttgtaacggttttattctgctggggtaacatttacctcaaacgcgggcaggcgtacgcttctcgcgcttactgacaaaccatcatcaaaaataccgatggaagggaacatttatgcgaattggcataccaaaagagcggttacccaatgaaacccgtgtcgctgcgacgccgaaaacggtagagcagctactgaagctggggtttagcgtcgctatcgaaagcggggcgggtcaactggcaagttttgacgacaaagcgtttgcgcaggctggcgcggatattgtagacggcaatgctatctggcaatcggaaattattctcaaggttaatgcgcctgaagaagaggaaatcgctttactgaaccccgggactacgctggtcagttttatctggcctgcgcaaaatcctgggttaatggagaaacttgccgaacgtaaggttacggtgatggcgatggactccgtgccgcgtatttcccgcgcgcagtcgctcgacgcgttaagctcaatggcgaatatcgcgggttatcgcgccattgtagaggccgcgcatgaatttgggcgcttctttaccgggcaaatcactgccgccgggaaagtgccgccggcgaaggtgatggtgattggcgcgggcgttgccggtcttgcggctatcggcgcggcaaacagcctgggggcgattgtccgcgcgtttgacactcgtcctgaagtcaaagagcaggtccagagtatgggggctgagttcctcgaactggattttaaagaggaagccggtagcggcgatggttacgccaaagtgatgtccgaggcgtttatcaaagcggaaatggcgctctttgccgcccaggccaaagaagtcgatatcattgttaccaccgcgttgattccgggcaaacctgcgccgaagctgattacccgcgatatggtcgattctatgaaggccggcagcgtgattgtcgacctggccgcgcagaacggcggtaactgcgaatataccgtcgccaatcaggttgtgacgacggacaatggcgtaaaagtgattggctacaccgatctaccggggcgtttgccgacgcagtcatcccagctttatggcaccaacctggttaacctgctgaagctgctgtgcaaagagaaagacggcaatattgacgtggattttgacgatgtcgtgatccgtggcgtgacggtgattcgtgacggcgacattacctggcctgcgccgccaatccaggtttccgcgcagccacaggccgcgcctaaagcagcacctgcgccaaaagagccggaaaagcccgcttccccctggcggaagtatgcgttaatggcgctggcgatcattctttttggctggctggccgatgtcgcgccaaaagagttcctcggccattttaccgtgtttgcgctcgcctgcgtggttggttattacgtggtgtggaacgtgtctcatgcgcttcatacgccattaatgtcggtgaccaacgcaatttcagggattattgttgtcggggcattattgcaaattggtcagggcggctgggtcagcttcctgagctttatcgcggtgcttatcgccagcattaatattttcggtggcttcaccgtgactcagcgtatgctgaaaatgttccggaaaaactaaggggtaacacatgtctggaggattagttacagctgcatacattgttgccgcgatcctgtttattttcagtcttgccgggctttcaaagcatgaaacgtcccgccaggggaataacttcggtattgccgggatggcgatcgcgttgctggcgaccattttcgggccggataccggcaacgtggcatggattctggtcgccatgattattggcggcgcgattggcatccgcatggcgaaaaaagttgagatgaccgagatgccggagctggtcgcgattctgcacagtttcgtgggcctggcggcggtactggttggctttaacagctatctgtaccatgacgccagtctggcgccggtgctggtgaatatccatctgaccgaagtcttcctcggtatctttattggcgcagtcactttcactggatcgatcgtagcgtttggtaaactgcgcggcaaaatctcttctaagccgttgatgttgcctaaccgtcacaaaatgaatctggcggcgctggttgtttctttcctgttgctgctggtttttgttcgtaccgaaagcgtgggtctacaggttctggcgctactgctgatgaccattatcgcgctggcgtttggttggcatctggtcgcttctatcggcggggcggacatgccggtggttgtttcaatgctgaactcctattccggttgggctgccgcggcggctggcttcatgttgagcaacgatttgctgattgtgaccggcgcgctggtcggttcgtcaggcgcgatcctgtcttacattatgtgtaaagcgatgaaccgctctttcatcagcgttattgctggtgggttcggtactgacggctcctcaacgggcgacgatcaggaagctggcgaacatcgcgaaattacggcggaagagaccgctgagatgctgaaaaactcccactccgtcattattacgccggggtacgggatggcggtagcgcaggcgcagtatccggtggcggaaatcaccgaaaaactgcgtgcgcgcggtatcaacgtgcgtttcggcattcatccggtggcgggtcgcctgccggggcatatgaacgtgctgttggcggaggcgaaagtgccttatgacatcgtgctggaaatggacgaaatcaatgatgatttcgccgataccgataccgtgctggtgattggcgcgaacgatacggtgaacccggcggcgcaagacgatccccgcagcccgatcgccggtatgccggttctcgaagtgtggaaagcacagaatgtcgtggtctttaagcgttccatgaatactggttatgctggtgtgcagaacccgctgttctttaaagagaatacgcaaatgctgtttggcgatgccaaagccagcgtggatgcaattctgaaagcgctttaatcttttaaacgtgcggcggcctctttggaggccgtttttatacatttcaccctataagctgcctctttgttggctgcgctcagaaaccccggtcacatcgttatctatgctcccggggatttcttcccttgccgccgcgatgcatcttgaatgattttgtgtatatattgcattttatcttttgtttaaatcgctaagcagaacggcgatactctgcccgccggtggtctgttcgagggcgattttgacaatgatggttaacggaacggagagcaacatgcccaccggacctaatagccagccccagaaaattaacgacaaaaataccactaaggttgaaaggcctaaaccacgtcccatgatacgtggctcaaggatattgccgaagaccagattaatcagcagatagcccgccagcaccagcagcgcatcataaaacccgttaaataccagcacctgaataatgggcggcagggcagcgagcaccgatccaatattagggatatagttcagcgcgaaggccagtagaccccagacaaaggcgaagcggacatccagagcggccagcattccccatgcgaccagtcccgtcacgatactgatcgctgtttttagcaccagataatgtgaaacgctatcaagcgcgcgttgaattgccgccataccttctaccggacggctcatcatctgctgcagtttttcaggcagttgtggaacctccagcagcatgaataccacggtcaataacaataaaaagatggatgacatggcattggacagttgggtgagcaggttcgttaccagagtcatggcggcgtttggatcgatatatttcgccagctcatcaaccgacacgccaatgcctgctcgctgcaaccacggttcaatacgttgcaacggtatcaccaatgaggagcgatactgcggtagggtacgggccagttcatttaatgatgtccccaaataggccagtagcagtaccattaacataacaataatcacaatgagcaatgatacggcgataacgcgcggaattcgacatcgggtcatccgttgcacaacgggattgagaacgactgcaataaataacgccaaaataaagggaacaatgatatctgcggcgaagcggataccgctcagaataaccaccagcattcccagcataatgacgatttttagaccattgagcgtgatgatcggttttgccatatcagtccctgttttctatgccgacacgaataataatgtgatgtcggtcgacctgttctggttaaaatcaaacacttcaggtaaagaagtgaaaatattttgagttaattcctggcttatgatacaaatcaggcgtgttcaactaccgaggacaattatcatccgcgatgacgagaagcaacactgcggataattgtaatattatggacaatatgttcagcgcttttttctccacgcaaacgcatcttcactctacctcctttttcctgcttatcggcgagcagcactggcgtaacgcactttagtctctcacttctgcctgagctggcgcaatgcgctgtgctaactgattttattttttagtttgctgcgtgcagcagactcgaaagagtatattctcatgcaggagaagtgtcatgttttactggattttattagctctggctatcgcgactgaaattaccggcacgctctcaatgaaatgggctagcgtgggtaatggcaatgcgggttttattttaatgctggtgatgatcacgctgtcatatatatttctttcttttgcggtaaaaaagattgccctgggtgtagcgtatgccttatgggaagggatcggcattttatttattaccatttttagcgtgctgctatttgatgaagcattatcaaccatgaagattgccggcttgctgacgctggtcgccggcatcgtattgatcaaatcagggacgcgtaaacccggcaaaccggtgaaggaggcgactcgtgcaacaatttgaatggatacacggcgcctggcttgggctggcaataatgctggaaatcgcggctaacgttctgttgaaattttcggacggctttcgccgtaaatgctatggcatcttatcgcttgccgctgttctggccgccttcagcgcgctttcccaggcggtaaaagggatagacctgtcggtggcgtatgcgctatggggcggttttggtattgccgccacgctggcggcgggctgggtgctcttcggccagcgcttaaatcccaaaggctgggttggcgtgatattgctgctcgccggaatggtcatgataaaatttgcctgagacgatcgctgccggtcaggcagcgattcccgcattaatcctgcgccagagctttcagcttatcgcgaaagccggtgacggatatagcgcggttatcggcgcgccagcgatctttagccgcaggggcggagctttgtacgccaatgagctgccatccgctatccgtgtgcaataataacggcgagccgctgtcgccaggtaacgtgtcgcactggtgtgagagtacggcattctgcgcccagccggtcacgacgcaatcctgatgggaatagagcgcattcagatgatcttccggataaccggactgcgtgacttttcggtctgcggctttcaacgccgcagtgagcgccgctttatcgccggtaaataaaggtactggcgtgataccggaaggtgggtagcgcaatattaccagaccaaaatcccagcttgccgcggcaggcggcacaatccagccatcgccatccgctttcaaacgtcggcccagcgacggttcaacgcggccttcaatgccgtggatttcatagcgccatactccttttcgcgccacaaaacgcagcgcaaccgctttgtccggttttcctttcggcggcgttagcaggcagtgacctgctgtcagggcgatatgcggggagataagcgttgccgtacacaaattaccgctggcggtctctagttgcccgatggcatcccacggcgattgggttggatcggcgacgggcactcgatcgtcatggttaaaaaaaagcgttttgacgtcgctggcatccgtggcgtctgtttcagcccccccggctttcgccataaccggtaaaaaacacactatgcccagtaatacagcaatggttttatgcatatcacactctggtgggtaattatgattattaacaacaaaccctcagtactactatagacgtgacggtaagaaagtgggagtaaaatcagataactacactcaggaaagatagaaatgcgtggcaataacggcgcataaaataagcacgataagaatgagctcaaagcggtagcgagacacttttttgccctcccggaaggcggcgctaaaccagaacgatttagcgccgtaaaaacgggcgcgggggcgcgccgcagcatgttacgacttacgcagctggttgcgaagttgtttttgacgtagatttggctggggcttttttgccatcttttttctggtgctttttagccgcctgcgctttttgctcaacggtttttttatgctgttttttgtggtgctgggtggtctgggttgttttggcaggcgctgcggtttttgcaggcgttgcagtctcagccgcgaatgctgcggaagagagacccattgcagcggcaacaaccagagctaatacttttttcattttgataccctcgatttggttttcattcaaccccactgcggggccggtgaaatgactatatcgctgttatcaaaaggcttccgtgagtgattggtttcggcatgtaacgctatgtacaatcccccggtaacgcgatgtaagcccccaccataataggtagctttacgttaccggccgttatttttggtcgcagagtcggtaatatccgccctccagaataacaggcacaccgtatatgaatccgataatctgggtggtatttacgcttctggcgctggatgcaatcagagaagtcatgggcgtatcaagcctggcaggtctgtggtgaacagtgagtcgtggcgtgaaaccagcccggcgatagcgcacgttgctatcgccggattattgtctatggaaaacccccagctaggctgggggttccggaaagctttcagctttaagccagttattaaaaccccttttgatttgttaaaacatcttgcggtctggcaactgcaaaagttcaacaagaaatcaaaagggggtcccaatgggggacgaaaagagcttagcgcacacccgatggaactgtaaatatcacatagttttcgcgcccaaataccgaagacaagcgttctatggagagaagcgtagggcagtaggcagcatattaagaaaattgtgtgaatggaaaaacgtacgaattctggaagcggaatgttgtgcagatcatattcacatgcttctggagatcccgccgaagatgagtgtgtcgagtttcatgggatatctgaagggtaaaagtagtctgatgctttacgagcagtttggggatctaaaattcaaatacaggaacagggagttctggtgcagagggtactatgtcgatacggtgggtaagaatacggcgaagatacaggactacataaagcaccagcttgaagaggataaaatgggtgagcaattatcgatcccgtatccgggcagcctgtttacgggccgtaagtaacgaagtttgatgcaaatgtcagatcgtatgcgcctgttagggcgcggctggtaagagagccttacaggcgcatcagaaaaacctccggctatgccggaggatatttatttcttttcaggcgtgaagacgatgatgtagccgcgtcccgaccaggatggccagcaccagcattagcgcgataaaaccacctacgccgttccagccgtaactatgccagaatacaccgcctagcgtcccggcaatactggaccccagataatagctgaaaagataaagtgacgaggcctgtcccttcgcccggcgcgcacgcgggccaatccagctactggccacggagtgcgcggcgaaaaagccggcggaaaaaagcagcatcccggcaaaaatcagccaaagcgaggtaaaaagcgtcagtaaaagcccgcccagcattactgcggtagagaacagcatcaccggcccccggccatagcgtgaggtcattgcgccagctttcggcgagctccatgtgccggtgagataggctacggataacagtccgaccacggcctggcttaattcccagggggagagcatcaggcgataaccaatgtagttaaacagggtgacgaacgcgcccatcagtaaaaaaccttccgcaaacagcagtggtaaccctcgatcgcgccagtggagacggaaattaataaatagcgttttaggccgtagcgacgtgggacggaaatgttgcgaggcaggtaaaatcttccagaacatcagcgcggacgccagcgcaaagcatccgatggccgccagcgcgatgcgccagttaaaaaagtcggtcatgacgccgcttaataaacgcccgctcatcccgccgatggaattaccgctaatatagagccccatagagaaagcgacaaagctgggatggatttcttcgctcaggtaggtcattcccaccgcggcgacgccgcttaacgacagaccgatcagcgcgcgcataatcagaataccatgccagctggtcatcatggttgataacaatgtgcagcaggaggctaataacaaggcggtgaccatcaccggtttacggcctatcgcatcagaaagcgggccggtaaaaagtaagccgatagccagcatggcggtagaaatagaaagtgaaacgctgctgctggcgggggagacgccaaactcctgggaaagtaccggtagtataggctgaacgcaataaaggagtgcgaaagtcgccaggcccgcggaaaaaagagccagcgtgacgcgcatgaaaggcgctgtaccgcgtttaataaattgaaccggctgagaatggcgttgttcatcgatatcgctcgccgtggcgtcatcgagaatagttgtacgactcacgttaaatccttgctttacatctccgtcaacaggagacgggtataaccgacatgtaaagcatagaaaaagcaaaatattctgtctaatatattaattgtctcaaataagacgttaaaaatatgaatatcgaattacgtcatttacgttactttgtggcggtagcagaagagctgcattttggtcgcgccgccgcgcgcctcaatatctcgcagccgccgctcagtcagcagatacaaattctggagcagcaggtcggtgcgcgattactggcgcggaccaaccgcagcgtagcgttaaccgccgccgggcgacagtttctggcggatagccgacacatcctgagtctggtaaacgacgccgccgctcgcgccgagcggttgcatcagggcgaagcgggcgaaatccgtattggttttacgtcttcagcgccttttattcgggcggtatcgcataccttttcgttgttccgccagtcctatccgggggtgcatatgcaaacgcgtgaaatgaatacgcgtgagcaaatcgcgccgctcaacgaaggcgtactggatattggcttgctgcggaatacgccgctgccagacacacttaatcgcgaggtgattttgcatgagccgcttatggccatgatcccgcgcgaacatcggctggcgcaaaagccagtcgtcagtctgacagaactggcggaagaacctttcgtctttttcgatccgcatgtcgggacgggtctctacgacgatattctcggcctgatgcggcgctataacctgtcgccgaccatcacgcaggaggttggcgaggcaatgactattatcggtctggtggcggcgggactgggcgtctcgattctgccggcatcctttaagcgtgtacagatgagcgagatgcgctgggttcccctggcagaagaggacgccgtatctgaaatgtggctggtatggccaaagcatcatgaacagagtcatgccgtacagcggttttgccaactgctattactggctgcccgacaggattaattacgcttaaaaagggtgaaaatgtgcagttaatcacacggctaagcaaaaagttgacggcgagtattgaagtgtttcaccatagcacacagattatttcggagcgcgaaaataaagggagtgagcggtggttgctgatagtcagcctgggcatatcgatcaaattaagcagaccaatgctggcgcagtgtatcgcctgattgatcagctcggaccggtatcgcgaattgacctgtctcgtctggcgcagttggcgcctgccagtattacgaaaattgttcgcgaaatgctggaagcgcatttggttcaggaacttgaaattaaagaggcgggcagtcgtggacgtcccgccgtcgggctgatggtggaaacggaagcctggcactatttatctattcgtattagccgtggcgaaattttccttgcactgcgcgatcttagcagcaaactggtggtagaagagtgtctggcgctgccgttaaacgaagctacgccgttgcttgagcgaattattacgcacgttgatcggttttttacccgccatcagcagaaactggagcgtttgacctccattgccattacgttaccgggcattatcgataccgaaaacggtgttgtgcaccggatgccgtattacgaagatgtcaaagagatgcctttgggagatgcgctggagcggcacaccggcgtaccggtttacattcagcatgatattagcgcctggacgatggcagaggcgctttttggcgcctcacgcggcgcgcgcgacgttatccaggtggtgattgatcataatgtgggggcgggcgttatcaccgacggtcatttgcttcatgcgggcagtagcagtctggtagagattgggcatacccaggtcaatccttatggtaagcgctgttattgcggtaatcatggctgtctggagaccatcgccagcgtcgatagtgtgctggaacttacgcagcttcggcttaatcagtcgataagttcaatgttgcatggccagccgttaacggtagattcgctgtgtcaggcggcgatgcagggagatctattagcaaaagatattattagcggcgttggcgcgcatgtcggacgcattctggctatcatggtgaatttatttaatccgcaaaaaattcttattggttcgccgctaagtaaagcggctgatattctttttccggccattgctgacagtatccgtcagcaggcgctgcccgcctacagtaggaatacggtagtggaaagcacgcagtttaccaaccagagcacgatggccggggcggcgttggtaaaagacgcgatgtataacggctctttgttgattcgtctattacagggttaacattttttaactgttgtacaaaaatttgcgctaactcaagctgattgcccttgccatatcttagactttctccactgtattattttcctggcttatattttcgaagcataacggtggagttagtgatgctgaagcgtttctttattacaggtacagacacttctgttgggaagacggtggtttcccgcgcattactacaagcgttatcgtcgggtggtaagagcgttgcagggtataaacctgtcgctaaagggagcaaagagactccagaagggatgcgcaacaaagacgctctggtattgcaaagcgtctcttcgctggagttgccgtatgaggcgattaatccgatcgcgttaagcgaagaagaaagcagcgtcgcgcatagctgtcctataaattacaccttgctgtccaacggtctggcgagtctgagcgataaagtggaccacgtggttgtggagggcactggtggctggcgtagtttgatgaatgatttacgtccattgtccgaatgggtggtacaggaacagttaccggtattgatggtggtggggattcaggaggggtgcattaatcatgcgctactgactgcgcaagctgtcgctaatgatggactgcccttaattggctgggtggcgaatcgtatcaatcctggcctggcgcattatgctgaaattattgatgtgcttgggaaaaaactgccagcgccgctgattggcgagttaccgtacctgccgcgcgccgagcagcgtgagctggggcagtatattcgtttgtcaatgctcggcagcgtgctggcggtagatagaatcatggcgtaacgttcgcgagagcactgacgcgactacacaggcaatcagcagaccggggagtaactgatactcgccggtcatttcacaaatcatcagggtggacattatcggcgcatgagttgtcgccgccagtagcgtcgccatacccgccagccccaataaaatcgctatttcatccgagcctggcagccagaatccccatatccgacccagaaacattccaatggataatccgacaaataatgttggcgtaaagacgccgcccggcgcgccagacccgctgctggcgagcaccgccaggattttgcacgcaaaaattccgccaatcagcgagaatagcggcggggagagcaaaaatgattgtacgacgctatagccgtttccccataccgtgggcgtgagtaacgacagtaatccgacaataagcccgcccaacgccagttgccagggcggggacagttttaagcgtaagaaactattatggctggccgtcatcagccacatcagcaacggaccccacagaccggcgaccagaccggtactgactatcatgacgtactcccgcgcgtagagatcaacggtcagatgtacggtatagagtagtgaatcgctaccgtttaatacatgggtggttagcagggcgacgacggcggaaacgacaaccgggccgagggaagccagcattaaggtaccgaacaggatctccgcgataaacaggctgcccgccagcggcgcatggtaagcgcccgccatgcccgcagcggcgccgctggcgatccataatttccattcctcacgcggcgtgaagcgtcgggcaaagctggacgccgccagcgcggcgaggaggatcattgcgccttcgcgaccaattgcgctgccgctgaccacgaccagcagcgaggccagcgatttcaccagactggcgccaacgtcaaattgcccgtcggtttgcaatgcttccatatagtcagtgggcgcatgggggcgctgttggttcattttttgccacccccacagcaacagaccagcggccaggccgccaagcgccggcgtaatcagccgtcgccagggcgaaagcccctcagccgcattcaccagactgccggtgtcattactcaggaaaatccactccagcaattgcatcgcatgacggaaggcggcgacagccagcgccgcgagaataccgatgagcgtagcgatcagcaggcgacgaaacatcgcgcgcagatccgggtaagcgtgtaaacgatgcatgagcgggtaaacagggagtttcaggatagcctattctgcggggaaatggcgtcagacgcaaaagcactatgtgcgatataatattgcgtacaataatgatactgccggatagcgagaggcgatccggcggcaacgttagctgctttcgtgaatatttagcgcccgacgagtgcggcctgagctgagataatcggcgatgtaatcctgagagatttcaccgttatagcgtccgtcttcatcaacgatcggcatccagctggtattactttcgtacaatctggacagcacaatacgcagattatcttccgctttgcccgtaatacggaaaggatgggtgatatcggcgcagattccgctggcgttccgcgcctcccggcgcttcacaaatcccagtggcttaccgtcgttgtcaatgacggtaatggcgcgaatatcgtgatcatccataatgccgaacgcctcgcttaacggcatggaaggccgcgcggtaatggttggctgttggtcggtcacatcgcctgcggagaccagtagcaaacgctttaacgttctgtcctgaccgacaaacgacccgacaaactcgttagccggcttggccagcagttcatcaggactggcgcactgtacaattcgcccctgacggaacacggcgatacggtcgccgagttttagcgcttcgtcgatatcatggctgaccagcatcacggtcttttttagcttacgctgcatatccagaaactggttctggatcacttcgcggttaatggggtccaccgcgccgaagggctcatccatcagcagtaccggcggatcggcggccagagcgcggatcacgccaatacgctgttgctgtcccccggacatctcctttggatagcgatgcagaaattttctggcatccagcgccaccatgtccatcaactcttcggcgcgttgcttgcagcgcgctttgtcccaacccaacatgcgcggcacaacggtaatattttcttcaatcgtcatattaggaaacaggccgatctgttggataacatacccaatattgcggcgtagcgttaccgtatccatatcgttggtattctcgccgttgataagaatattaccgctgctgggcgcgatcagccggttgatcatctttaacgtggtggttttgccgcagccggagggaccgagtaagacgcacatttcgccttccggcacgttcaggttgacgttgtcgacggcttttagcggctgaccctttttctgtacaaattgtttggtgagattttccagttttatcattatcgtatccccttaggtgccagtacgacttgcagacgatgcaacagccagtcaagtacaattgccagtagacagatcatcagcgcgccggcaattaacatgcgaatatcgctgccgctaatgccgtttaacagtagcagccccagaccgccggcgccgatcaccgcggcaatcgccatcacgccgatattcatcactaccgcggtgcggatacccccgaaaataaccggtagggccattgggatttcgacccagcgcagccgttgccagaaagtcataccgatgccgcgtcccgcttcacgcagaccgggcggcaaactatcaagcgcagtatgggtattccggacaatcggcagtaaagagtagagaaaaacggccgtcacagcgggcagaacgccaataccatgcccgatcagcgaaaagagcgggatcattaatccaaacagcgcgatagacggaatggtaagaagtagcgtggcggcgcccaataccggcgttgccagccatttgtggcgtacaatcaaaacgcctaacggtacgccgatgataatcgccagaccgacggccagcgcgactagccagagatgctgaaaggtaaggctggcgagatagcctgcgttatccagcatataatgtatcgtatccataggcgctccttacagcagacctttgtcctgcaaaaattgatgggctacctgttgcggcgtgcgatgctcgatatcgacctgggcgtttagggtcgatatcacatcgttattgagcaggccggaaagggtgtttaaggcgtcatcaagaccaggattggcttccagcacctctttacgcaccacgggcgtgacagcgtaacttggaaagaagcctttatcatcttccaacactttcagatcaaaccctttcacccgtccgtcggtggtatagaccagcccggcgtcaaccagtccatcccgaacggcgttatagaccagccctgggtccatctgtcgtatttgcgggcgatcgagctgcatctggtaggcttgctgaaggggcttcatcccgtcgctgcgcccggcaaattccagatcgaggccgagcatccagttgtggtcaggatcgttctgccggacttgttcgatttttgccaccatttgcgagatggtggtgatattttccgactcggcgcgtttacgctgcatcgcgaacgcgtaagtattgttcatgtcagccggtttgagccataccaggcccagcttcgcatccaggcgttttaccgtgtcgtaggtttcctgtggactcatgcgcttatcgatacggttgaaaataatcagcgatgtaccggtatattcccaggtaatatcaatttgtttattcaccatcgcattacgtgaaatcaccgcggcgatattggtttgcggctgaacctgaaagcctttcttctgcaaatactgaacggtcatagcggaaagaatatgctgctcggtaaagcttttggtggcgagaaccagcggcgcggcctgcgtctggctactgaacaacagcgttgtggcaagccatcccaacaggtgttttttgaatctcatttaacgctccttattgttatttatgcgttcagacggtatgagggctaaggcgtcgcccaaaccaggcaagcagagtgtcaagaatcagcgcgaataacgccgtggccgttgcgccgagaatcaacgtcggaaaatcgttgagataaatccccggaaaaatcagctcgccgtagctgctggcgccgatcagaaaggccagcggcgcggtgccgacattgatggcggtcgcgatgcgaataccggacagcatcactggccacgcattaggtagctctacctggcgaagccgctgccattttgtcatcccaatcccgttcgccgcttcaatcagtgaggcgggaacggaacagaggcctgcataggtattgcggacgataggcagaagagaagccagaaatagcgcgacaatggcgggcgtatcgccgatcccgataatcaccatcgctaaggccaggacggccagtggcggcaaggtattaccaacattaaagatttgcatgacatattcagcaaatccttttgccgcaggtcggctgagtaaaatcccgctcgggataccgaccagtaaagcaaaaaacatggacgtaaagaccagcatcaaatgccgttgtccgagatacagcagatcgacctgacgcgctttcagcgtctccagaccgattccccagataaacagcgccagtaacagcagaatgacgatagtgaacccaagtacgcgttttagggtgaggatgtgcattgcggtgtgtctccctgtttgcatgtgttatggcgacgttaagagtcgcgtgttgttatgccatgttccggcagggtgctttgagctatagcaacaggttgggaaggattccagcggagcgtgatgtttaacactgttaaacatctattaacaattatgttttgcccttatgcggcttagcgtgaacattcacgataaagaattatcttaaaaatagaagcgaggtgtgacgttgtcactttttgtaggtaaaaataggccacaatgggagaaaaggcaggtaaaatcctgccttttgtggggattaacggaataacggttttacagcgacgggaataatgagttgagcttgccattgcgccagagtcagacgcgccagttgccccaacgcctgataaaacggatgcccggcatgatcgataaatacgtccagaaagcggggcgaccacggaaacagatgccaggccaggagttgttcgcattcatgatgacggccattctcggcaagccaggccgccagcaacaacagcgccccaaaatgatcttctggctcgttttgctgcatttcaaactgaatcccgttttcgcgcatccactgacgtagcgccaacgtagaatcgccaaataatacgctctcacgatccagccagacggaaccccacggcggagacggcagagcgtaagggccgataaacaggcgctgccaggcttgtggcaacgactcttcgctgtgggtcttaaacatagccgccacaggtgcaagcgcctcggcatcaagcggccactgcgcctgccagtcgtcgtttaatagcgcctggaccagaggagcggtttcgtggctttccggcgaataataaaacaacgcgccaagaacacgcgccgttactgcaaaatcatcacgttgtaaaaaagtggtcattcaaacaatcccgaaaggtgcgggtcgccccgcacgcataaattaacctgcgacggccatacctacggtcatatgcaggccataaaaaagtccgcggccaataatttcgcccgccagcaccagtacgacaccgagcagcaaaccaacggtatgcggttcgcggcgacggattagtggacatagccagcaacctaatccggcagcaagcaagacaatgcgccagacctgtagcataccgtaatccggtgcgagatggctggcctgttgcacggaactgtgaatggctgagagggacagtccctgtagtacgatgaccgccacgcacaccaccaacgccaggccgctaatactggcaaacgtcacgctgcaaaatgggacgcgcgcgatgcgtagcagtagcgccgcaaacaccggaccgcacaggaatgccgtgaggaaaaaggccagcgtggtgtagccattataccaggttggcacggtatctatctgataaacgagcgtcattgcccagatgaatgcaacgccgagcgccatactgaccagcagccacactttacccagcgccgggggcattttaccgagtaccgccaccagccaccagatgccgcctacggcaaagaacaccgatcctgcggcgatttcattactcagtgcggaagcgcctacgcggttaagcgagttaaacgcgcgcatcggcaagccgagatgcataatcgacgcgaggaatcccagtcccatcaccagccacagaaaaaacatgctgcgcacgatgcgttgttttgccacatcgtctttggtggttaaccagccatatccactcacgatcagcgccccggccacacattgacccagcaccgtaaacaggaccagcggccattcatgccatccacttcccatcttatacctccttcggattggccagataaccggtggtgtccccggtcgggcggctgttggcgttgggtttaatcacaatattcggcttcgtgaaatgcgtgcgcggcaacggcgcgacggcagccagctcaccgtgttttttgcgcagttcgtctatcgggccgaaatccagcgcccgcagcgggcaggattccacgcaaatcggtttcttgccttccgccacccggtcataacagccgtcgcacttggtcatatgacctttggccgcgttgtactgcggcgcgccgtacgggcaggccatgtggcagtagcggcagccgatacagacctcttcattcaccaccacaaaaccgtcatcgcgcttgtgcatcgcgccgctcgggcagactttggtacaggccgggtcttcgcagtggttacaggagatggagagatagtaggcaaagacgttctggtgccagacgccgttatcttcctgccagtcaccgcccgcatactcataaatgcggcggaagctgacgtcgggagtgagatctttgtagtccttgcaggccagttcgcaggttttgcaaccggtgcaacggctggaatcaataaaaaatccatactgggttgtcatcggttactccttacgccttttcaacctgaacaagattactgtgtgacggattacctttcgccagtggggaaggccggtgcgacgtcagaatgttaatggagccgccgcgatcgactttgtcgccaaacatgtcggcatttaaccaggcgccctggccgatagcggtgacgccaggcaatatgcgcggcgtgacttttgccggaatgagcatctctccattctggttaaagacccgcacggtgtcgccgtgctgaatgccgcgcgcttgcgcatcaatcgggttgatccagatctcctgcggacacgcctgttgcaggacgtcgatattgccgtagctggagtgggtacgcgctttatagtggaagccggttagctgtagcgggtagcgctgacgaagcggatcgtcccaaccgtcaaagcctggcgtataggcgggtaaaggatggataatctcatctttcttcagctcccacgtgttggcgagggttgccagacgctcggaatagatttcgattttaccggacggcgttttcagtgggttggcggcagggtcttcgcggaatgagcggaaagcgacgtagtgctcctccgggcattttttcttgaaaatccctgtctgtttcatctcttcgtaatccggcatttccgggttacgcgctttggtttttgcgtgcaggtatttgacccactcatgctgcgtgcggccttctgtgaaggtctggtatacgtccggaccaagccgtttagccacttcactgagcgtccagtaaatgggctttctttcaaatttcggcgaggtggcgggctgaccaagaatgacatagcccatattgcctgcggattcgtgggaaatcagatcttcctgctcggtcggcattaaatcaggcagcagaatgtcgcaatattttgccgacgcggtcataaagtgctcgatgccgacgatcatttcacatttactgtcgtcctgaagcacctcgtgggtgtgggcgatatcgccatgctgattgatcagcgtattactggcgtagcaccacaaaaatttgatcggcacgtcgagcttgtcttttccccgcacgccgtcgcgtgtggcggtcatttccgcgccatgatcgatagcgtcggtccaggtaaagaccgaaatctgggtttttaccgggttctccagcataggaaaccattcgacgcccagatcccaggtgccttcgcgcacgccggaattaccgccatttatgccgacgttaccggtgagtacagacaacatggcgattgcgcgtgcggtctgctccccgttagagtggcgttgcggtccccagccctggcaaatgtaagccggtttcgccgagccgatttcccgcgccagttgaatgattttttccgccggaatactggtaatctgcgcggcccattgcggcgttttagcaataccgtcttcgccctgacccaaaatataggctttatagtgcgcgttacgcggggccgaggcgggcagagtggtttcgtcgtagccgatgcagtatttatccagaaacggtttatcaataagatcttcggtaatcagcacccagccgattgccgccgccagcgcgccatcggtacctgggcgaatcggcagccactcgtcttcgcggccggcagcagtgtcgttataacgcgggtcaatgacgatcatccgggcgttggagcgttcgcgcgcctgttcgacatagtatgtcacgccgccgccgctcatacgtgtttccgcggggttattgccaaacatcaccaccagttttgtattggcgatatcatccggactgttgccgtcgttgccgccgaacatatagctcatggccgcgctgatttgggcggtgctgtagctaccgtaacggctgagatagccgccgcaggcgttcatcaggcgatacggtacgttagaattggtaatattgccgccgtccacgccggtaccgtaaaggacatgtaccgcttcgttgccgtagtccttgaggatgcgtttaaggttatcgccgatggtatccaacgcttcatcccaactgatacgttcgaatttgccttctcctcgtttaccaacgcgtttcatcggatatttcaggcgatcgggatgattcatccggcgacgaatagaacgaccgcgcaggcaggcgcgtacctgatggttgccatattcatcgttgcccgtggtatctgattcaacccaatatacggtgtcatcttttacgtgcaggcgcagcaggcagcggctgccgcagttaacggtacatgaactccagaccgctttttctgccatattgccagatgcgaggtctgctgcggcgtgggcgatgcgggagaacggaagggtgaaagcgctactggcaagcgcaaggctaccgatagcggaggttttcaccaggcttcgtcggctgatactggccgccattaatgcctcagggttggtgattttcataacagctcctcactatgctcatccaaaaaagagttttaaatgtcgttgtgttcgcaaaacggggagctccgggcgcgtaaaaacgccccggagcaggcggcttagattttttcgatttccaccagatttgtatgttgaggattcccttttgccaggggggaaggacgcagcgtcgtgagcgtattgatgcaggcgccgtggtcaattttatcgccagccatatccgcattatgccatgcgccctgacccatcgcgctgacgcccggcagaatacgcggcgtgaccttggcgggtagacgcacttctccacgatcgttaaagacgcgaaccttatcgccattcgcgataccacgtttttgcgcatcaagcggatttatccacacctcctggcgacaggcggcctgcagaacatcaatattgccgtagcttgaatgggtacgggatttatagtgaaagccaaacagctgtagcgggaaggtgctccgcttcggatcgtcccatccttcaaaagtaggggtataaatcggcagtgggcttatcacgtcgccttccgccagctcccaggtactggcgatgtgagcgagtttgcttgagtagatttcgattttaccggacggcgtttttaacggattggcctgcggatcttcacgaaattttttataggcgacaaagtggccgttgggatctttgcgtttatagatgcccattttttttagctcgtcatacgcgggcaatgccggatctcttgcctgcattttggcgtacagatattgcagccattgcgcctgggtacggccttcggtaaaccgctgatacacatcgtcaccgaggcgtctggcgatttcgctgagtacccagtagatgggcttgcgttcaaacttaggcgtcgtcgccggttggataaaaatcagatatcccatattgccggcgtaatcattggggatgatatcttcctgttcgacggtcatgagatccggcagtaaaatatcggcgtacttcgcggaagaggtcataaaattgtcgatgaccacaatcatttcgcattttgcttcatcctgaagaatttcatgggttttattaatatccgaatgctgattaatcagggtgttgccagcgtagttccatagaaatttgatcgggacatccagcttatctttgccgcgtacgccgtcgcgcagggcggtcatttccgggccgcgcgcaatggcgtccgtccagctaaagcaggagatggcggttttaacgggattctccaggaccggcagacgttcaatggtaatggtgtaagtggattcgcgtgcgccgccattaccgccatgaatgccgacgttgccggtcagaatcggaaacatggcgatggcgcgagcggtttgttcgccgttcgcctgacgctgcgggccccaaccctgacagatgtaggccggcttgacgctacctatctcgcgcgccagtttgataatccgatcggcggggatgccggtaatgtgtgacgcccactgcggcgttttggcgataccgtcctcgccctggcccaaaatataagccttataatggccattggggggggcgtcagccggaagggtcttttcatcgtagccgatgcaatagttgtcgagaaaaggctggtcaacgagattttcgttaatcaatacccaggcaattcccgccaccagcgcggcgtcggtgccggggcgaataggtatccactcgtcttcacgtccggcagcggtatcggtatagcgcggatctatcacgatcatgcgcgcatttgagcgttcacgcgcttgctccagaaaccaggtaatgccgccgccgctcatgcgtgtttcagccggattattgccgaacatgaccaccagtttactgttttcgatatcagatgtgctgttgccgtcgttggatccataggtgtagggcatggcgcaagaaatttgcgcggtactgtatgagccgtattgattcaacgaaccgccgtagcagttcatcaaacgcttcaccggcgaggcggaaggcgacgagcgggttatgttgccgcctacgatgccggatgaatagtggatataaacggcttcattgccgtagatctctacggtctttttcaggctggcgctaatggtgtccagcgcttcctgccagctaatgcgttcaaatttgccttcgccgcggcggccaacgcgtttcatgggatagttaaggcgatccggatggttaatgcgccgacggattgaacggccccgcagacaggcgcgaacctgatgattgccgtagacatcgtcgccagtgttatcagtttcaacccaccagacttcattatcttttacatgcagacgcagggcgcagcgactgccgcagttgaccgaacaggcgccccagacgattttatcttcttcgttgcgcatagcctgctgcaccgccgcggccgcggtacgcatcccaaacggtaaagatacgcctccggcagccagcgccagtgagccaagcgccgctgatttcactaacgtcctgcggctaacgcctgtttgctgcttttctccgggcatcactcactccattgtcgttatcgtttcgctatatattaatgactatagcgaaattattaacatgctaatgatgtaatgagtttacccctttgggagtaaggattattaatccatgtcaaagagcgttaccctccggacccggagggcaggaggaggttattgtggttcggcggatgaaccgtcctgagcgggagaggtattggctggcgcattgccgctgctggtgcgggtataaagaattttatgcgtgtcgttcgcgcaatggcccaccacctgtgagtccggctgatcggcctggtcgtataggaacgatagtgagcgtaaaattatccgccggcacgccgttattgatgatacgttgttcgatatcgctttttactctctcgcacgatcccggtgccgccatcaccagcgagggggcgctgactaacgccagagcggctattgcagttgcgattttcatcatgaactcctgtgattaatgacgatgttctaagcttagcatttttcgtgtaaataactgtatttgctaatatgatgataaatatcttttcatcctggtgacacgcgtgaagaaaccccttttactgacgttattgtgcatgatactggcaggttgtgataacccgaaatcccccgagtcttttacgccggaaatggccagtttttcgaacgaatttgattttgatccattacgtggtccggtaaaggatttcagccagacgttgatgagtgagaatggcgaagtggcgaagcaggtcaccggtacgctttcacaggaaggctgttttgatacgcttgagttacacgatctggagaataatacggggctggcgctcgtgctggatgctaattattaccgggatgctcagacgctggaaaaaaaggtgcagttacaggggaagtgccagctggcggcgttgccttcggcgggcgtgacttgggaaacggacgacaacggttttgtggtatcggcgacgggcaaagagatgaaggtcgagtaccgctatgatagcgaaggttatccgttaggtaagacaaccataaactcgcagaatacgctctctgtgacggcaaaactctccacggactcccgtaaaaagctggattatacggcagtcagccgggtggatgatcgacaggtcggcaacgtcacacagagctgcgaatatgatgcgtacgcgaaccctgttgactgccggcttgttatcgtcgatgagagcgttaagccggcagtgtcccaccattacaccattaaaaatcgtatcgattactactaaaccgggcgcggtgcgactctccgtgactaccgcgccgcgcttactgcgcggtgggtttcaggagcgtagaactggacgttttatgttcatccagatactgctgctggaagatacacatgcggatggtgttacggtattcgccgttaatgaagaactcatgaatcagctcgccttctactctaaacccgagtttacggtagatgtgaatcgctttttcattctctttatcgacgatcaaatacaatttatagagattgagtacggtaaatccgtaatccatcgccagtttggccgcgcgtgacgccaggccttttccctggtactccggcgaaataataatctgaaattccgcccgccgatgcacatggttaatttccaccagttctaccagtccggcgttttcaccgtcgcattcgacgacaaagcgccgttcgctttggtcgtggatgtgtttgtcgtagagatccgacagttcgacaaaagcctcatacggctcttcaaaccagtaacgcataacgctggcattattatcaagctggtggacaaatcgtaaatcttcacgctcaagcgggcgcagtctgaccttgtagtcacttgtcatactgtatccttacacttccttttagttatcctgcatcagggcgtaataacgcgacctgtacgacgatccagacaccgcagagtattgggttcccaataggcgttgatgttggcgctttgctcgcatttatcgcggttatcaaaggcggcatcggctttgtcccactctttttctgcgcgggtattcactttctgacgcagactgcgagtgtcgttccattgttccttttccatcgccgcttcctgacgactttgtgcgctatctcccgattcaatcaccagtttactggtttcagcgaatgcggaagtagtatatacaacggccgccaacgtaagcattgccgtcaggcaaaggcgtttgctcagcgtattgttcatcacaacatcctttcattagaggggaaaaagcggtaaaccacctgtaaattctacaccaatccttatgcctggcatatacacaagaatggccggataaccgtaacgatattctgttgtattatcacttatcatttcgtaaccaaatgaatctcatgctaaagacgactctgcttttctttgtcaccgccctctgtgaaatcattggatgttttcttccctggctatggattaagcgcggcgccagcgtgtggtggcttctgcccgctgccgcgtcactcgcgttattcgtctggcttttgaccttgcatccggcggcgagtgggcgggtttatgcggcttacggtggggtatatgtctgtactgcgctcctgtggttacgtgttgtcgatggcgtccggctcacggtttatgactggagcggcgcgctgatcgcgctgtgtggaatgctgattatcgtcgttggatgggggcgtacgtaacattgccgcgctgccagaacattttgtgatctggcagcgctttttagataaatatacttgtatggtagtagctcagttgggtaaatttcctgcatcccataatgcgatgtaaggaataaaaatgaagattgtaggggctgaagtttttgttacgtgtccagggcgtaacttcgtcaccttaaaaataaccacggaagacgggatcaccggtctgggggatgccaccctgaacggacgcgagctctcggtggcctcgtaccttaccgatcatctgtgtccacaactcatcgggcgggatgctcaccgcatcgaagatatctggcagttcttctacaaaggtgcgtactggcgccgtggtcctgtcaccatgtccgccatttccgcagttgatatggcgctatgggatattaaagccaaagccgccaatatgccgttgtatcagttactcggcggcgcttctcgtgaaggcgtcatggtgtattgccatactacaggccacaccatcgacgatgtgctggaagactacgcgcgtcataaagagcaagggttcaaagcaatccgcgtgcagtgcggcgttccggggatgaaaaccacctacggcatggcgaaaggtaagggactggcctatgagcccgcgacaaaaggccagtggccggaagaacaattgtggtcaacggaaaagtatctcgattttacgccaaagctgtttgacgccgtgcgtaatacgttcgggtttaatgaacatcttctgcacgatatgcatcaccgactgacgcctattgaggctgcccgctttggcaaatgtattgaagactatcgtttgttctggatggaagacccgacgccggctgaaaatcaggagtgcttccgcctgatccgccagcatacggttacgccgattgccgtaggcgaagtctttaacagtatctgggattgcaaacagctcattgaagagcaattgattgactatatccgcaccacgattacccatgccggtggtattaccgggatgcgccgcattgccgattttgcctcgctctaccaggtgcgtaccggttcgcatgggccgtccgatctgtcgccggtttgtatggccgcggcattacattttgacctgtgggtgcctaactttggcgtgcaggagtttatgggctactccgaacagatgctggaggttttcccgcataactggacgttcgagggcggctatatgcatccgggcgacaagccaggactgggcattgagtttaatgaaaaactggcggcgaaatatccgtacgatccagcctatttgccggtggcccgtcttgaagacggcacactgtggaactggtaaggagcgaaaaatgaaaagcatcgtaatcgaaaaaccgaatacattaaccatcgaaacgcgcgcgcttctgcagccagcatctggcgaagttcgtattaaagtgaaactggcgggtatctgcggttccgacagccatatttatcggggacataatccctttgcaaaatatccccgtgtcataggccatgaatttttcggtgtcatcgacgcggtaggcgacaacgtcaatcgcgaccggataggagaacgggtatccgtcgatccggtgatcagttgcgggcattgttacccttgttcagtcggtaaacccaatgtgtgtacctcgctggtggtgctgggcgtgcatcgtgacggcggtttcagcgagtatgcggtggcgccggcccgtaatgctcatcgcataccggacaacatcgcagaccatcatgccgtcatggttgagccgtttaccattgcggcaaatgtgacggggcaggtgaatccgaccgagcaggacgtggcgcttatctatggcgcaggcccgatgggactgacgaccgtacaggcgttgaagggggtttatcaggttaaaacggtcatagtcgttgatcgcattgaagaatcgcctgcggcacgcattgtcctgatgggattttccagcgacccgtgtgagattgtacagcagggtattaccggaaaagagctggctatttattcatcgcgtcttaatgccaataaattcccggtcgtgattgactggctgaataaagggcttattgatccggataagctgataacgcatacatttgattatcaacatgtcaccgacgcgattgagcttttcgagaaagaccagcgtcaatgctgcaaagtcttactcacgtttgcgaaataatataaatacttgcgagtaagtggtacgcatcttacctcttagagattgcctatatgacacaaataaagcatgaacgatcgactcaggatttagtgcgcgctgccgtatctggctggttaggcaccgcgcttgaatttatggattttcagttatattcactaggcgcggctctggtcttccatgagatatttttcccggaacagtctgccgcgatggcgcttattctggcaatgggcacctatggtgcaggttatatagccagaattatcggcgcctttgtttttggtaaaatgggcgaccgcatcggacgaaaaaaagtattgtttattactatcaccatgatggggatctgcaccacgctgattggcgtactgccgacgtatgcgcaaatcggcatttttgcgccagtattactggtaacattgcgaattatacaggggctgggcgccggggcggaaatttccggcgcgggtaccatgctggccgagtatgcgccgaaaggaaagcgtggcatcatttcctcgctggtcgcgatgggcaccaattgcggtacgttgagcgcgacggcgatctgggcggtgatgttctttgcgcttgaacgcgaacaactgatcgcctggggatggcgtattcctttcctggcgagcgtcgttgttatgatattcgcgatctggctgcgaatgaatctgaaagaaagtccggtattcgaaaaagtaagcgaaggcgaaaaatcgccagcgttaacgcctgcgtcagaaaatacattgggcgcgatgtttaccagcaaatctttctggctggccaccggtttacgttttgggcaggcggggaattccgggcttattcaaactttccttgccggatatttagttcagacgttattatttaacaaatctatcccaaccgatgcgttaatgataagttccgtaattggttttatcactatcccactcttggggtggttgtccgataaatacggtcgtcggctaccgtatataatattgaatatctccgcgattattctcgcctggccgatgttgtctattgtggtagataaaacgtatagccctggcgtaattatggcggcgctcattgttattcataactttgccgtgctgggattatttgcgctggaaaacatcaccatggcggaaattttcggatcgcgtaatcgcttcacccggatggcgatttcaaaagaggcaggaggcctggtggcggttggctttggccccgtcctcgcagggatcttttgtaacatgaccgattcctggctgcccatcttaattatgctggtgctctactcgtgtattggtctgatttctgcgctgttgatgccggaggtcagagatcgcgacctgagtttgcctgaggatgcggcggaagcgacagcggcagagaagttacgccactccgcaacccagacgagttaaatcgtgtcgacggtatggccggaacgttaatgcggtttcggccatgctgtccggtcacttttgtttaattagcgtaaatccaaatgcaccagggcaggcgttactctgcgactgttccgctttcagaatatagaggttataaaatgcaaaacaggcttttatcggcaaaggcgacgcttcctgattacgatcgcgcggcgctggcggcgcggatggtccatctcggttttggcgcgtttcatcgcgcgcatcagggggtttatacagatattctggctgcggagcagcatagcgactggggctattatgaggttaatcttattggcggcgaacagcagattgccgatctaaagcagcaggataacctctataccgtggcggagatgtcggcggatgcctggacggcgcgtgtggtgggcgtcgtcaaagcggcgttgcatgttcaggttgatggtctggaacgtgtgctggcggcgatgtgcgaaccgcaaatagcgattgtgtctctgaccattaccgagaaagggtattgtcattcgccagccacgggtcaacttctgctggaacatcccatgattgccgccgacctgcaaaatccgcatcaaccgctaacggcaccgggtattattgtcgaagcgttagcgcgtcgtaaagccgcaggcttaccggcatttaccgtgatgtcctgagacaacatgccggaaaatgggcatgtgacgcgtcaggttgtgacggcttacgcccgggaggtggatgcggaactggcgatatggatcgagcaaaacgtgacatttccgtcaaccatggttgatcggattgtccctgcggtcacgccggagacgctggataaaatcgaacaactgaccggcgtgcgcgatccggcgggcgttgcctgtgaaccgtttcgtcagtgggtgatagaagatacgtttgtggcggggcgtccgcagtgggaaaacgcgggcgcgacgttggtcgccgacgtggttccgtttgaagagatgaaactgcgaatgcttaacggcagtcattcattcctggcttatctggggtatcttgccggctatcagcatattaatgactgtatggatgacgacaactatcgtctgaccgcgcaggcgttaatgttacgcgagcaggcgccaacgctgaaagtccagggggtagatttacagcgttatgccgatcagttgattgcgcgttaccgtaatccggcgctgcgtcatcatacctggcagattgcgatggatggcagccagaaacttccgcagcgtatgctggactccgttcgctggcatcttgctaatcatagcgattttgatttgctggcgctgggcgtggcggggtggatgcgttacgttggcggcgtggatgagcagggtaaggcgatcgacgtcagcgatccgctattgccggttattcagcgcgccgtggcaaacagtgaagaaggcgccagtcgtgttaaggcgctgctgggaatggctgaaattttcggcaacgatttgccgcaggcggcgcggtttacgcaaaaagtgcaagaagcctatgacagtttactgacatatggcgcgaaagcgagcgtggcgaaatatgccgagcgcttgaaatagcgtaacagagacccggtagcattatgctaccgggaaggccggagcggttcttagcggccagtggtatcagttcatgccaagacgaatcagttcgactggcgcgaatttaccttcacaaccttcgacaatcaccgttttgccgcggcgaatttgacctgcatccagaccttcgctctcaatggctttgataatcccggtatggcccgtgccgcttatcatgacccggctaccggtggtgattgcgttacggttacgatcgtatgtcatcatggtgttttctcctttcaaacttactgccaaagcccgcaggtttccccgcatgacgggcgacatataaatacgcttatcgttgcggattttttttgtttttgatcaagctcacggctttttaggcgggaatgtgcagggcgagaaagcggagaaggcgtctcaccccgacgttaaagggggttactcttcgctaaaccagccgctgttttcctgacggataagctgaacggattcgctaatttcctgcaaatgctgggtcattgcgctctcaaccgcattgccgtcacgattttccagcgcggagaaaatatcatggtgctggcgcagcaacatctccggcggagaaacatgatccagactcatatagcgaacccggtcaattgtcgctttgatattttcaatggtatcccacgctaactggcaatcggcgatctgcgccagtttttggtggaaatcgtcatcaagctggaaaaaatcatcaatctgtttgcgctcgatggcaatatgttgcaggtgcaggttttgcgccagttgatagcactggttgtcggtgatcatcgccgccgcacggcggaccaccgcgcattcgatcgcctgccgaacaaagcagccattctgtacctgagaaagcgaaatcttattcacataactaccgcgctgagggcggatctgaatcaacccattttccgccagctttataaaagcctcgcgcaccggctgacgcgaaacgttaaaacgggttgagacctctttttctgatagcggcgtgccaggcgggataagacaatgcacgatatcacgccgaagaatacggtaaatttgctggttgacaggctgtgtagggttaagctgcgtttcgacggtcattcattcttactttttaggcggttgacccggatactctaccacttttccgtggcggtctataccgatcatgtttctggttgcagatacgtttgccagggattacccggcccgcagaccgggtataaccccttagctacggtggacgctgagccctgcgaaggattgggtaacaggcatcatttcaacggtattaatattcacatgcgcggggagtgtggccacccaccataccgcttcggtaatgtcttctggcgtgagcgcggtggtattttcgtaggttttacccgctttctcatcgtcgcctttgaaacggacgctggaaaactcggtgccgccaaccagacccggttcaatgtcggtcacgcgaaccgccgtgccgtgtaaatccgtgcgcaaattcaggctaaactggcgcacaaaggctttcgtcgcgccatagacgttgccaccagcataaggccaactgccggcggttgaaccgatgttaatgatatgaccgcgattacgttcgaccattcctggcagcacggcgcgggtcatataaattaagcctttattattagtatcgatcatagtttcccagtcttctacgctggctttatgcgccggttcaagacccagcgccagaccggcgttattgaccagcacatcaatatcgcgccactgcgcaggcagagaggccatcatctcttcgatggccgcgcggttgcgcacgtccagttgggcggtcaatacgttctcgccaagctcatcttttaacgcttgcaggcgttcatgacgacgtcccgtggcaatgactttatgtccattctcaacaaaacggcgtgcaatgcactcgccaaaccctgcggttgctccagttactaaaacgatcatcacacagttcctcaacgctttttgtgttgtattaccatagcacgcggcgtttatgaaagggtaatcctggttaacacggttgcggtcagcatagggggaagcttactcttatgatcaacctattttcaggagtgaaaaatgtcgacgaatcctttgttagaccagagtatgttgccttatcaggcaccgcgttttgatcggatcaaagattgccattatcgtcctgcttttgatgagggcgtgcggcaaaaacgcgtggaaatcgaggccatcgtcaatcatccggcggcccctgattttacgaatacgcttctggcgctggagcaaagcggggcgcttctgtcacgcgtcaccagcgtttttttcgcgatgacggctgcgcacactaacgatgaactccagcggttggatgaggccttttctgccgagctggcggcgctctccaacgatatttatctgaatagcgcgttattcgctcgcgtggatgccgtctggcaacagcgtcactcactggggctggatgatgagtcgctacggttggtcgatgttatccatcagcgttttgtgttggcaggcgcgcagcttgccgaagaggataaagcgcgactgaaagtattgaatactgaatccgcgaccttaatgagtcagtttaatcagcgtctgctggcggcaagtaaagcgggcgggctggcggtagatgacgcgcattgtctggaaggattaagcccggaagaaatgaccgtcgctgctgaagcggcgcgtgaaaaaggcctggaggagcgctggttcattccgctccttaatacgacgcaacagcctgcgcttgctacgctgcgcgatcgccagactcgcgaaaatttattcgcagcgtcatggactcgggcggaaaaaggagatgcccacgatacccgcgctatcgttcagcgtctggtagagattcgccgctgtcaggcaaaactgctgggtttccccaattatgccgcatggaaaatggccgatcagatggcgaaaacgccgcaagccgcactgagctttatgcgtggcattgtgccgccagcgcgtcagcgggtactcaatgaacaggcggaaattcagaacgtcattgatggtgagcagggcggctacaccgttcaggcctgggactggatgttctatgccgaacaggtacggcgggaaaaatatgcgttagatgaagcgcaactgaagccctattttgccttaaatacggtgttgcaagagggggttttctggaccgccaaccagctattcggcatcaccttcgtcgagcgttttgacattccggtgtaccaccctgatgttcgggtgtgggagattttcgactccgatggtgtcggcatggcgttattttatggcgacttcttcgcgcgggactcgaaaagcggcggcgcgtggatggggaattttgtcgagcaatccacactcaatgaaacccggcccgttatatacaatgtatgtaactatcagaaaccggttgatgggcagcctgcattgctgctttgggacgacgttattacgctcttccatgagtttggtcatacgttacatggtttgtttgccgttcagcgctatgccacgctttcaggtaccaatacgccccgcgactttgtcgagtttccctcccagattaatgagcattgggcgagccatccacgtgtgttcgaacgctacgcgcgtcatgtcgacagcggtgaaaaaatgcctgctgatttacaggaaagaatgcgcaaggcgagtttatttaataaaggttacgatatgactgaattgttcggcgccgcattgctggatatgcgctggcatatgctggaggagagcgtagcagagcagtctgtcgctgagttcgagcagcaggcgctggccgccgagcatcttgatttaccggcagtgccgccccgctatcgcagcagttattttgcccatatcttcggcggcggctacgcagcgggatactacgcctacctgtggacgcaaatgttagcggatgacggttatcaatggtttgtagagcagggcggcctgacgcgtgaaaacgggcagcgttttcgtgatgctatcctttcccgggggaatagtactgatttagaaacgctttattcagcctggcgtggacatgaaccgcatattgacaccatattgcaatatcgtgggctcgatcactaagctgatacggttgttcggcactgtcgaacaaccgcctgaaaatgaatcctgcacttctgatgacagccagttaaatttatggggttaagttgtctgaatataacgagggcgtgcattcggatttttctacttattttcccgtggtggcttgattgccaaagatttattaccgcttcgctgttgatgttttcaaaaaatatattttccgccatgtggtggtattatgtaaataatgcagaaatgaatttaacactgcgcacagggcgactagatttagaactgtatcacatgatatgagaagacatatcatatttaaaacgcaacatcatcatgaggattatattatggcagaacatcgcggcggttccggtaattttgcagaagataaagagaaagcctcagaagcaggtcgtaaaggcggccagcatagcggtgggaactttaaaaacgacccacaacgtgcatctgaagcgggtaaaaaaggtggccagaatagccacagtggcggacggaaatccggcaattaattttactgctgatatttcataaatatattctgaaatattgcacatacgatgcgggccataggctcgcatttttttattctgaccgggagttattctgaccggtcagatgaaattattgtttatgctttcttcgttaacagaaaaagcaattcagcgagggcgaagcgtacgcatttttccaatacttcctgacaatctccgttgaaatgttgtcggcttgtaaaagttgtattgttaatattccaggcaaaccaaactgtgcccgccggcgtgccatcttcgccgccttccggaccgccatagccgctgatcgctatgctgatattgacctcagcctgatccttagcgccctgtgccatttcagtaacaaccgcttcgctgacggcggtatgttcggcaagactgtggcgttgtacgcgtaagatttttgctttggcttcatcagtaaaggtgacataccccacaccgtaaaatgagggcgtatcttctgctgcgcacaatgctgacgccagtttcccgccagggcaggattctgcactggtcagacggagtttctggttaaccagtaaatcaccaagtttttttgtcaggctatcgacggattcggcttcatcaagggtgacaatatcgtgctgttctaatctcatcgtttatttttccgttacagagacaaatgaaatctgttcgttcttctcaagtatggcatatttattttatgacattgtcagtgaatgattattttatccagttaccaacaaacccgctgttgcataacttgcttactttcttacggcgatgactgtcattgattatgtggaaggccattatcctcaaaaaataaagccgattattctgaattgctatccagacgttgatgcatatgacttcagctatgtggcaagttaactattacgccgttacgctttcgcgctcactggcgctgatatcggttgcatattaatccggatgggttgattttattgcttaatattctgcgggtaaattcatgtttgtaaaaactaaaaatagcggccagacttaatacgtcaaatagacgttattaaggagagagcatgaaactacaggtggctgcatttttaagttttctgataatgccttacgcgctagcggaagatcaggggggattaaaaaaagacgtggcaccgccgccgcctcatgctattgaggatggttatcgcggtacggatgatgcagaaaaaatgaccatcgaacaggcaaaaaccctgcatgatggcgcgaccgtttcgctgcgcggcaaccttattgatcataaaggcgacgatcgctatgtatttcgtgataagtccggcgagattaacgtgataattccttccgccgtatttgatgggcgggaagttcagccggatcaaatctggacaagaaagcgaaggaaccgcttgtccgcgtgaaccgattgcaaaaataacgcgcgctaaccggcaatatccaggtcagccatacggggcatgcggctggcctgatactatgggtcttgtaaaagcgccctggggacaaaaggtcccataatgtcttattcaggtctggttgcgtatcgtttaagcttcattgatattgacggtgctacagtcgttagcgatccgttatcctcgcaagaatttgcccggtagcgtataagcaaaacacaaatctatccatgcaagcatttaccgctggtgaaccggcggtttttttttgcctgccatccagacaaaagcggccccttgcgcaacgatgcagcaaggggccggctctgcgagggattatctccgttcattaatcatcccatttgtgactgaaccaggcggccagaaatccggaaaataaaataattcctaatacaacgataaaaaggttaatactacctaacatctcgtttctccttattttagcgtgcatcctcttttttaaaaaacctcgtacaaactatagtactaatttatacttaagcaaagtctgaattgcgtatttattttactggaagggtaaagcattagaatattttcgtcagcgcccaggaatattcctgaattaccgcagttacagcagataattagcctgcaatatatagggttaacccagtgcgccagaaacagcgcacatgactggctgcagataattaacaggtgatagcctgttgcgtaggggtaatccgcattccttttaacatcagtgcccaggcgaacacaatggcgattatcaggacaacgaaaagcgaccaggcgggaagcgtcgtcaggatgacgccgctggccagcgggtttaccgccgcacccagccagcccagcgattgcgctgaaaaatagctggctttcatcccggcaggcgcaatgttgtcaattaacatatattcgccgggggcataaataatttcgccaattgtgaatactgccgctgaaagcccccaaaaaaacagattgtcgcctgaaaaaataaatccgatgagcccggcgataaaaaagacggtgccggtcgtcatcattggtcgaatattgacggcggtaagtcgacggcccacggcgtattgcaaactgaccacaataaccgcattaaccggcaggacgacggctaccactttttccgcgaagccgctatcggcaacgaccataacgtactgtgaaatacaggacgcaaaggcaacccccacaaaggaggccagaaatgccgaaagcgtaaaccacaataatgctttgtcgcgcagcagaacggagggagaccagatagcggcatttttcccctcgctggcggcaaccgaacgtgtcacccatacctgaataaagaccagcggaaatgcggaacagatagcggcaagccagaagggtaaattgatgctttgcatcaccagcagcgtgccgagcggcgggccaaccgtccagccgatattgagtacggtatagttgagcgaaaaaatccgtgtttttgttgtcgcggtgaggttatcggcgaaccaggccttcaggacggtagaaaaaaccgaataggcgcagttaataagcgcaaaaagcaggacaaccagtacgacattatgcaccattgggatggcgataaatccgcaggcgaaggcgataatcgcgagtaacatgtagcgctttttatcaaacttgtccgccagaatcccaaagccaagactaaagatgacgccgatcgttaacgcgctggtcagcgcgtagccaatcagatccacgcctaaaccgtactgacggttaagatagatggtcataaaggggagcgtggcgccgcgtccaattgtcaataacagcgatgaggcgagtagagccaacgtcgaacgtctcaatcctggattcatttttcctgcctgaaatggaggttacgtatcgggacgttttaatctaccgtgcccgcaaaagcatgatgtctgtacgctatagcgtagtcttaacataccataacgcaggattttgcccatcgtgtgttgttcaatgccatgctcacggtaaaaagaaaagtcctgttatggcgcactgatttccgataacttacctttttacaaaattttaataatgacaggggccgatgatgtcgcgtaaagacggttttttggcgttactggtggttgtcgtatgggggctcaattttgttgtcatcaaagtaggcctgcaccatatgccgccattattgctggcaggattaaggtttttactggtggcgtttccggcaattttctttgtcgcccggcctaaagtcccgcttacgctgttgctgggctatgggctgacgataagctttgggcagttcgcctttctcttttgcgcgataaagtttggtatgcccgcaggactggcgtcgttggtattacaggcgcaggccttttttaccatggcattgggggcgtttgtttttagtgagcggttacaacgtaagcagttagcggggatcgccctggcgattataggtgtactggtattgattgaagccagtctcaacggacagcatatagcgatgtcgggatttatgctgacactggcggcggcatttagctgggcctgcggcaatatctttaataaaaaaattatgcaacatagtccgcgcccggcggtgatgtcgctggtggtctggagcgcgctgatcccgatcctgccgttcctgctgtcatcgctgctactggagggggcggatcacattacgcaaagccttattaccatcgatatgacgacgatattgtcgctgctttatctggcttttgtcgccactatacttggctacggcatctggggcacgttactggggcgctatgagacctggcgcgtggcgccgttatcattgctggtgccggtagtcgggctggcgagcgccgcggtgttactcggggaaacgttgaccgggatgcagcttgcgggcgcagtactgattatggctggactctatatcaatgtgtttggatttcgtgtgcgccgtactgcgcgcgtcaggggatgaggcattatgttactaagaagacaaacgctaatttcagaccatgccgcggggtaatagcggcggacttgtcatagccagacggtactaaaaaaatgccccgcaaaacggggcaaagaggttaaaggtgttggtcgttataatagggcacgcctaattcatctgacttatcgctgttcacgctcacggggtgaaggtcatttggcggatcgcccacacagggcagaagcatcacatcgcggctattttgcgccacaggtaacaaagtttgttctgcaatgccatatccggaggcgataagtaacagacccggcagggcgggaaacagcattttcatggtgctcttcgcgtggcgcataaacaaactagtagttgccatggttcagcggcagcatataccgtgattcgccatgcatattggtgatccggtatttgtgtggcggcacatcaaaatagtttttgaacgtccgggtcaatgtttgctgtgactcaaagccatagcgttccgccagatagagaatgggctcgttgctctcttttaatttttgcgcgatttccgtcatcttacggctgcggatgtattgacctaatgaatgaccggtctcttttttaaacatccgttgcaggtgccatttggaatatcctgaacgctcagacactttttccagtgagagcggcgactccaggttatcctcgatccagtccaaaatgctatgaatagtaatagcgtcagtgttgcgtctggacatcgtcatacctcttttttgtctacggcagaattttcttgagcaaatactcaagcgttgccacttcgtccgccgttaagttttttgttaattcctgatgcaggtcttgccctggtcgttgatgacattgctcacaaattgccgcgccgtccggcgttagcttcaccagtacgccgcgtttgtcattaggattcggcagtctttcgatccagcctttgcacagcaggcggtcgagcatccgcgtcaatgcgccgagatcgacagacagcacttttttaagttcaaccggggtaatacatcccgcgcagcgtatcgagcacagcactttaaactgtgttgcggtgatatccagcggggataaatagttatttaacaggcgatcttttttttgatttaccatgtagatcaagcgacccagcggaatgatttcattgaacagatcactggtgcttttcaaaatggttgccccggcaagtaattaattttgtcagatactattgcccaggcaagtataagtcaactaaatgaattggccgatgccacgatttgctaaaaggcgtccggggtattgtgctgtgataacttgtaactaattgataattacaggttataggttgtaaaaaatattgacttgcacactggcgaaatggcgcgcctgggcaatttcactttatacttccggttcatgaaacgctgatgggtaagagatagtattatgatggatttgtttaaagcgattggattggggctggtcgtactgctcccgttagccaatccgctaaccaccgtggcgctgtttcttggccttgcgggcaatatgaatagtgcggaacgcaaccggcagtcctatatggcttcggtttatgtcttcgctattatgatggtggcgtactatgccgggcagttagttatgaacaccttcggtatttcgattccagggctacggatcgccggggggttaatcgtggcgtttatcggcttcagaatgcttttcccgcagcagaaggcgcatgagtcgccggaagcgaaaagcaaatcggaggagctggcagacgaaccgacggccaatattgcgtttgttccactggctatgccaagcaccgcaggaccggggaccatcgcaatgatcatcagttccgcttccacggtgcgtcatggcggcgagtttcccgactgggtcattatggtcgcgccgccgattatttttcttgccgtggcggtgatcctgtggggatgcttacgcagttctggcgctattatgcggctggtgggtaaaggggggattgaagcgatctcccgcttaatgggattcctgctggtgtgtatgggcgtgcaatttattatcaacggcgtgttggaaattattaaaacgtaccactaaggcgcattgtcgtctgccggaaacctgttcccggcagacgaatgtcttaatgcggttgttcttccagcgtcactggccatttgcggaatatgagcacagcccataccagcgcggcacaggcgggtatggcgccaatatagccgatggccgacattgaccagtgcaaactcacctgattgcctaccagcgcgccagcgccaataccaatattaaagatgcctgaaaatagcgccattgcgacatcggtcgcgtccggggccagcgccagtactttcacctgcataccaagccctatcaccataatcgcgatgccccagaaaatgctcagtatggccagatgcgcttcgctatccgccgcaggcagcagcagaagcagacagacaaccagcagggcaatagcgatactgacgagcgacgaggcatgacgattacccagtttaccaaacacaaggctgccgatgatcccggcgccgccgaggatcagtaacaggacggtagcaaaattcgcactgagcccggcgacattctgaacgaacggttcaatatagctataagctgtgtaatgcgcagtcaccacaacgacggttagtacatagaggctcattagcgccgggcgccggaatagcaaaggtaaactttttagtgagccggaatgctcgctcggcaatttcggtagaagcttaatcagacatagcagcgtaattaatgcgcccatgccgatggcaaaaaaggtggtgcgccagccaaaatactgaccaacaacgcgacctatcggcagcccaagcaccatggccaacgcggtgccggtcgctatcagacttaatgcctgcgcgcgtttcccggcaggggccaggcggatcgccagcgaggcggttatcgaccagaaaatagcgtgggcgaaagcgataccaatacggctaatgaccagcacggtaaagttccatgccagaaaggagagcacatggctggcaataaacaaaacaaacagacaaatgagtagcttacggcgctccatttgactggtaagaagcataaaaggcagcgacataacggcaactacccaggcgtaaatggttagcatgatgccgacctgcgcggtttgcatatgaaagctttcagcaatgtctgatagcaaaccaaccggcacaaattctgtggtattgaaaataaaagcggcaatagcaagcgtaactacccgtagccacgcgaccttgcgggaaactggattgattgtcataaaaatatttcgggttagttgcgagaaggtgagaccgcgatcttaaaacgtttactggcgaaaagacaatcattttgtgacctgcttctcatttacttcgcaggccgtttcgtcttcagtcggcgctcgccagttgggcgttaagtaactcgataaaggcctcaagttgacgcgtcatcgccccgcgtcgccacattagccaggtgctaagccagcgccacttctccgccaacggccaggcttccacctgatgatgtcctggcatactgttgagcatacttgctggcatcagcgcaatacctgcgccggcaattacgcacgccaacattccatgatatgactccatttcgtgaatcgtaccgggggtcgcgccatcggcatgaaaccagctttcgaaatgccgtcggtaagaacagttggcgcgaaaagcatagatgttataaccattcacctcgctggcccgcgaaacgacggaatggccgtgtggcgcgacgatcatcatctcttcctggtaagccggtataccttccagccccggatgcattagcgggccatcaataaaggcggcgttcagctttccttcgagcacgccatccagcatggcgccggaaggaccggtcgttaacgcgaactgaattttagggtaacgctggttataacccgccagcagcgcggggatacgtacggcggcagtactttctaacgcgccgagtgaaaacagtccttgcggttcctctccggcaaccaccatacgggcttcatcaaccagcgccaggatctgctggctgtaacgtaaaaagttatgcccggctggtgacagcctgagtcgctggttttcgcgaataaacagagagacgcccaggtcggcttcaagctggcggatacgcgtggtcagattggacggaacgcggtgcacttttgccgccgcctgcgtaatgctgcccgtcagagcgacagcgttaaacatttccagttgcgtcaggtccatggttttctcaattcgtgaatagtctggttaatattattcatttttcagaaagggtaaagggcgtcatgatggtacaactcccctgataacgagagaaagaacatgaccatgatgactgcaacacaggcgttatccgttaatcctgcgaccggccagacgctggcggcaatgccctgggctaacgcgcaagagattgaacatgcgctgagtctggcggcgagcggtttcaaaaagtggaaaatgacatcggtagcgcaacgggcgcaaacattacgcgatattggtcaggcgcttcgcgctcatgcagaagagatggcgcaatgtattacgcgtgaaatgggtaagcctataaagcaggcgcgtgcggaagtgacgaaatccgctgcgttatgtgactggtatgcggaacatggtccggcaatgctgaatcctgagcctacgctggtagaaaatcagcaggcggtgattgaataccgtccgctgggcgtcattctggcgataatgccgtggaattttcctttatggcaggtgttacgcggggcagtgccgatactgttggcggggaatagctacttgttaaaacatgcgcccaatgtcacgggttgcgcgcagatgatagcccgaatcttgacggaagccggtactcccgctggcgtctatggatgggtgaatgccaataatgagggcgtgagtcagatgattaacgatccgcgaatcgcggcggtgacggtgaccggtagcgtgcgcgccggcgcggcgattggcgctcaggctggggcggcgctgaaaaagtgcgtactggaactgggtggctcggatccgtttattgtactcaatgatgccgatctcgagctggcggtaaaagccgcggttgccggacgctatcaaaacaccggacaagtctgcgccgccgccaaacgttttattgtcgaagagggcattgcgcaggcgtttaacgatcgttttgtggcggctgccgcagcattaaagatgggggatcctctggttgaagagaatgatctggggccgatggcgcgctttgatttgcgtgatgaactccatcaacaggtgcaggcttccgtcgccgaaggcgcacggctactgttgggcggcgagaaaatcgccggggagggcaactattatgccgcgaccgttctggcggatgtcactcctgacatgacggcatttcgtcaggagctttttgggcctgttgccgccattaccgttgcaaaagatgcggagcacgccctcgcgctggcgaatgacagtgagtttggcctgtcggcgacgatctttaccgccgacgatacgctggccgcggagatggcggcgcgtcttgagtgcggtggggtattcattaatgggtacagcgccagcgatgcgcgtgtggcattcggcggggtgaagaaaagcggcttcggtcgcgagctttcgcactttggtttacacgaattttgtaatgtgcagaccgtctggaagaaccgcgtctaatcgccctgacgtcgcgtggcgccctctgctatactcgcaggccttttcagacctgcgagcaaggagcatgttgtggccagggccatggataatgcaattttagaaacgattttacagcgcgttcgccccctcattggccagggcaaagtagctgactatattccggcattagcgtccgtcgagggttcaaagctgggaatagcgatttgtaccgtggacgggcagcattatcaggcgggcgatgcgcacgaacgcttctctattcagtctatttcgaaagtgctcagtctggtgatggcgatgcgtcattatccggaagaggagatctggcagcgtgtcggaaaagatccttccggctcgccgttcaattcgttggttcagttagagatggaacaaggcatcccgcgtaatccatttattaatgcgggcgcgctggtggtatgcgacatgttgcaagggcggcttagcgcgccgcgtcagcggatgctggaagttgcgcgcgcgctttgcggcgtatcggatattacatatgacgctacggtcgcgcgctctgaatttgagcattccgcccgtaacgccgctattgcctggctgatgaaatcattcggtaattttcatcatgatgtgcctaccgtgttgcaaaattacttccactactgtgcgttgaaaatgagctgcatggaactggcgaggacgtttgtctttctggcgaatcagggcgaggcgtttcatctcgacgagccggtagttacccccatgcaggcccggcagattaatgcgctaatggcgaccagcggtatgtatcagaatgccggcgagtttgcctggcgggtgggattgcccgctaaatccggcgtgggcggcggtattgtcgccattgtgccgcatgaaatggcgattgccgtctggagtccggagctggatcctgcgggaaactctctggcaggtatcgccgcgcttgaacaattaacacaaacgttaggacgtttggtatactgatgaatgcgcttgaaccgctctttgcccgcctggcgcgatcgacatttcgttcgcgctttcgtctcgggataaaagaaagacaatattgctgggataaaggcgcggaggtgattgataaacacgccgccgattttatcgcccagcgactggtgccagctcacccggcgaatgatggtaagcaaacgccgatgcggggccatccggtatttatcgcgcaacatgcgacggcaacctgctgtcgcgggtgcctggcgaagtggcaccagattcctcagggagaaccgctgagtaaagcgcagcaacagtatattgtcagcgttattcattactggctggtcatacaaatgaatcagcggtagggtagcgcgtcgttgctgacgctttccccgataaatcaccctataccactgatagcagccgttgaccgtcatatatctcatgtgctgaaatgtctttttagttacaacatacatttggttgtttttttccaacgcctgtcagcaccatgcaaaaaaatgttctacagagcagggaatccgtgtatcaccagaagcttgcaaccttgatctggatcacgtttaatgacagtgctttttcacctgctgaagataatcatgatcgttagaccacaacagcactggattcgcctgatatttgtctggcatggttccgtgttatctaaaatcttttcacgactgctccttaactttcttctttctatcgccgttattatcatgctgccctggtacacaatgctgggtattaagtttacccttgcgccgtttagcatactgggcgtcgctatcgccatttttcttgggtttcgcaataatgcctgttatgcgcgttacgtcgaagcccgacatttgtgggggcagttgatgatcgcttcacgctcaatactgcgagaggtgaaaacaaccttgcctgatgaacgcggtatcgaggattttgttcggttacaaatcgcttttgcccactgtttgcgtatgacattgcgtcgacagcctcaaacgcaagttctgggaaactatcttgaccaggaggcgttacagaaagttgtcgcttcccattcccccgctaaccgtatcttattgctgatgggagagtggctggcgattcgccgccgcagcggaaagctttccgatattttatttcatagcctcaacaaccgcttaaatgatatgtcgtcagtgttggccggctgtgagcgcatcgccaacacgccggtgccttttgcctatacgttaattttgcatcgtacggtttatcttttctgcattatgttgccatttgcactggtggttgatctgcactatatgacgccgtttatttcggtgctgatttcttatacgtttatcgcgctggatgcgttagcggaagagttggaagatccgttcggtactgaaaataatgatttaccgctggatgcgatatgcaatgcgatagaaatcgatttactgcaaatgaatgatgaaagggatattccggcaaaacggataccggataagcgctatcaactgacctgagttcgtcttaactggcgcagaatgttcatctgcgccataacctgaaaagcaaagcttaatagccttctccaacgccggttttggctggaccggagtagtggacatgaacgattcgccatcctgtgtttggtatcttcgcccatacctggctttcgcggcctgtcgtgtgttgagtctgcccattatcacggcgtaccgcggtaaaatgccagtcgaactctgcaacggcggcattgccatacacatgaatagccgggggagcgtccagttttaacgtgcgtttgctgaacgttttacccatagtggtgccataaaaattttcagcgatctgcgaccatccgcgttcgtgaccgcgtggatgaataaaactggtttccggtgaaacataaaaaagctgcttgcctaacgttgggtctgccttatctattgaataaaggtaacggttaatgctttctgtaatttcttgtttaacggtcgacgtagcttcattttgtgcggcggttggcgttgccgctgatgccgatgacgccatcagagttaacgttatcgcggcggctgaaaaaaatagtgacgttttttgcataatagttatacccatatggtctgtttttgagacgctttatctttcctgttacgttcacctttatactaaaggagcatggctctcgaacaataaaaaacatccttctataaaactaccccgaaaagggagtagtgcaattaagaatatcgtatttgtttgtaacggcatgactcaaaatatcaacatttagagtttcagtattgttgttgtcccttgacttacttttatgtttattaccactggtaaatagttaatcttatgaatagtgatacacaaatgaccgtttgcgctatgtgataattaaccatagtaaaaatacgcgaagcgaagaagtgctatttcagtagtactgatattttcataacgctaatttaaaaataaatgtaaacgtaacaaattatacacaaaaataagaagggctgtggcctcaactgacttgattatgattccgtcttaatgaagtgtcagcagagtgttcagtgccattctcacctcggcatccccgaccgtaagccagttctctactggtcacccccttgttattacagcagaaaacagggcacaccattgatgtagccatgcttaacttgcattttaacatcactaatacatagcaagctaatattacactttgaaacttaacgcacggtaattgttagtgatattgtcccggacagttccgcgagcaggttttgcggaaagtccaaaaataagacaaataaggcatataaaatgaaaaaagtagtggtgttatctgcggtagccgcagccgtgatgatggctggagccgccaacgcagcagaaatctataacaaggatggcaataaactggatttgtatggcaaggtcgacggcctgcattatttttccagtaatcatagtacggatggcgatcaatcttatatccgtatgggtattaaaggcgagactcaaattaccgatcaactaaccggttttggacagtgggagtatcaggtcaacgccaatcgtccggaagatggtgactccagcggttccccgcaaagctggacgcgtctcggttttgctggtttggcatttgccgatatggggtctgttgattatggtcgtaactatggcgtgttatacgacattggttcatggactgacgtactgcctgaatttggtaatattacctgacgtcgtcagtctggcctgatgaactaaccatcctcgcgcggtttccactactgctattttccactcgccatcatcaaaacgattccagcgtagggtaggaagggcgctcaaacttcgggcgagcgtaatgcagcgggccagcagacgtagcgcagtcgtttttccgctaagacaacaggctgacagcagcggatattcgatagccagaggcgagacatccaggggaccatgggttattaacgtatggtccggggacgacgccatcggtagtgtaggtgtaatgatattctgtactgccgccagccagcgggcggtttcagaacgctcttgcaaaaaccaggcttcccagccctttacgccagcggcaagccaggtctgaggatcatcgtcaaaaaagattgtgcttgccagcggggataactctccgcgacgtaacaacgcccattcttcagcggttgcctgtcggtggctaaacagggggagccagtcggtcaacgcgcgacggagcgtttctcgcgccaactcttgttgtgcggcctgcatatctggcttctcttcaggaaacaacagtaaagccgccgctgcgttgtgcgcctgagcgcacaacgtaaacaaacgtgaaataagcgtttttgcgtataccggcgttgcgccctgtaacaaacgaccgatcggcgcctcctgccaggtaatccatagcgggtgagaatagacggtcaatctttgcacgaattattaccttcatcgatcaccataaacccggacttactggtttcgcaaaccggacagcaccagtaatcaggtaactggttgaagggcacgccgggtggaatttgccatacatcatcgcccagcgcagggtcgtaaacccaccaacatactttgcactccatgcgcaccactggctcattttctgtgaccgggtattctttcaaccattccaacgtattttttagccccgtgtaggcatcttcgatatcgtcgatgcctgcaacggcgatatcaggaatgtccgctatctcaatcatatcttgcagtaatgtgttcatatcattgaaataattgacccgccatacgccgggaaaatgcgtgcttacaatccggcatttaccatatccgcgtgaaaaaatagcgctacagccttcgcctaaaaaatgatccagatactcgcgatcggcatcgtttactggcaatagcgttaaattaatgatatgcggctcttttaccggctgttttacgcgctcggctatttcatgcgcgataaaggcgccattcatcaatcccgccagttgtggcggcaattctggtgtaatcggcggctgcggatgcgtctgccagatgctctccgggatcgggccaatgataatttcatcggcaacccgttgctggtcagcgttatattcacgtacacgccagacgcccgtaaaaaccgtctcctgaatacgctgttcttttccatcggataatagtacccgggcggagatttcaccttcgccgagcagttgatccaataaaccgctattctgttgctcagtggcattcagcttatagctcaggggaaaggggagcgttgccaccgggttatccatatcgcgaataagcgtagtcaggatgtgtctggcaacacggagctcagcgggcagcgcctgttccggtaaaaccggcgtcagcgggagattaatgccggcggggatgggaagaaagttaaagtcttcctcttctggctgcgatcctggtccggcaatattaacgactggaatagttctggaatgattcacgtgtgttacctttcattctattgcgtaataacgggaatatcctgacgatagcccggtgtagtcagcaatgcggccacccgctgagagtattcttgccagctatataatcccgccagactgccgacaaaacggtgctggcgaaagaaaagcagcgccggatatttcagaatgcgatactcccgggcgatcagttcactctgttcgctatccgcaaatgccgcggtataagatgtcgccggaaattgcttgaggatctccgggataatgacccaactgtcggcgacttccggatgtttgttggggtcactttgcagcaaaaccagcagagtcggatgcgcattaatcaacgacgggagcgtttgcgcatcggtaaccagaaagcctttatccgccagtggacaaacaggattttggggtgagatagtcatttttttaaatgctccggtaattcaggcgtgcgagacaataaatcggcaaaaccggtcagcggatcgctttgcgtgagcatggcctgttccagcgagtccagcgccaccagtacctcaacggcttccgcttcgtccatttctcgtcgcgctgcgccgccaaatgtcagcagccatgcgcctgctaaggggggagccacaagccgaatatcaacgtcgataagctcgccgtgtcggtcgcggcatttggcgaaccactgaccgggtgaaataacctgcacaggaacgccaatacacattatgatttctctctctgtagcacccgaatatcgccgacccggcaagcgctttgcgcatctggccgttcatcttcgtagcgttccatacacaggctgtaatgattgagtctttcagtgggcaaggccgctgaagaggcggtgataccccattgcgccagcacttcctgcgcgagatagaccgcaggcatcagttgcgcccttacctgcggcgtaagactcccgccatagtcatccagacattccggctgcacgccaatcagcacaatctccgataactggccgccggttaattgcagcaatgccagcacttcagaaaaactggtctgatgtaaactaagttttttcgccgtcagataggcgggaacctgttcatcacgaaacatcgccagcgaacctggcgccataccaaaatcgatagcatccatgattaacagtttttctgtctgttgcagccagggcagcagcgccagcccctgcgtaccgccatcaacaacgtcaactttctcgttatcggcatactgttcaaacagcttttccgcagctctgacgccgaacccttcatctgcccaaagcaggttgccaagccctaagattgttacttctgccattgttatcacctgaaccagcgccagccgcttatcatgacggaaatcacgctttgtcggctcataatgtcttcgcggatagcggtataaacatgcgcaatgacgaaggcgataatgaaccacatgcccagccggtgccagaaatgcagcgcgaggctatcgttgccagtcaggcgaatcatccagccaaaccattgatacgcccaactgtctgttccaagtccttcgccatagagcgcaaagccgctacacaccatcagtacggacatccagaaatagaacattaccgccagtcccgctaccggattatgtccatagtaacgatgggcctctttttcgaggaaaaaataccagcggatttcgctgataacgcctttgcgccaggcgcggcgccagaatggaaccagaaacatctccctggcgtactcattgccgacacatgcccagtaaatacgaaacagcagcgcgacagtaaaaatatacgccgtggtaaaatggatcagtcgtatccagcccatccaaaacataaaggtcgcttcaccttgaatcgatggcagggggcggccaatgaaatatcctgtaacagccaggacgacaatggataacgccgtgatccagtgccataaacggaccggcgcttcatagatatagtacccctggctggttatttctttgagatgcattgagacctccgaatcgtcgtcatcgtacctgaaccctgaccagctcccctccatgattatcaataacatgggtggagcaggccaggcagggatcgaagctgtgcagagtacgtaaaatcttcaatggttgatcgggaacggcgagtttagtccccattaacgctgcttcgtacgcgccaatttgacctttatcgtcacgtggcccggcattccaggttgtcggtaccacacactgatagctgtcgattttctgattttcaatttttatccagtgccccagcgcgccgcgcggcgcctcgctgaaaccaacgccttttgccgatgtgggccaggtatcgggttcccagagcgtaacgtttgccgtcgccgtatcgccggacttgaggttacgcattagacgatcgaagaaatattgcagcgtattgcctgcccatacggattccagcgcacgcgcggcagtacgccctaatgtagaaaagagcgcttctttaggcagctttaatacactaagcagttgatccactggttctttaaattccggtttattttgatgatatccaatcaaataacgcgccagcggacctacctccatcgcatgtcccttccagcgcggcgatttaatccatgaatatttggcggactcatccacctgttcgataaaggtttttgtgcctttatagtgttcgcccatgaccagttgcggttcggtcagaccatcccacggatgcaggcccttatcgttattgccgttaccataggtataccaggagtgagtgacaaactcctgaatctcatcgggggcggttaaatcgacaggatgaatttcgtcgaaacgaccgttaatgatagccccacgcggaagcagaagattactggcggaataatcgttagggttatccggaaactcgccataagccagcaggttcatgctcgataacccgccgccgatttttgcccagtctttgtaataactggcaatcagcaagacgtccggaagataaacttgttcgcagaactggcgagctttttggatgatggaactgacaaggttcaggcgctccatattcactgcgccgaccgcgcccgtttcgtcaaggttgatggcgcaaggaacgccgcccaccagccagttaggatgcgggtttttaccaccgaaaacggtgtgaatttttacgatctctttttgaaaatcgagcgcttcaagatagtgggcgaccgccagcaaattggcttccggtggaagtttcatcgccggatgtccccagtagccgttacggaaagggccaagttaaccggactcgataaaccgcttcagtcgattttgcaaatcgcggaaatatcccggcgaggatagcggccatgcggaaaggctttgcgcgatggcggaggtctgatgcgggtcggctttcagggcggcaactacatcgacccagtccagcgcatgcagatgataaaaatgcaccaggtgatcgtgaacgtgtagcgtagcctgcatcatattacggatacagtttgcgttgtccggaatcgcgattcccagcgcattttctacggcacggattgaggtcagcgcgtgtgtaccggtgcagacgccgcaaatgcgctcaacaaatgcccaggcgtctcgcggatcgcgacctttcaggataacctccaggccgcgccacatggtgccggtcgacacggcgttagtaatgacattattactgtcaatattcacttcgcagcgcatatgctcttcgatgcgagtaaccggatcgaccacaattcgccgtccgctattgtccagcgtaaaaccctgagtctgataaggatatgccataattattttttcttttccgtagcgttttctgatgacgtgttgtttttattgcgggcgtgttttatggcgctaaccgtggcgtgagcgatggcagcagcgcccgcgacgccggcaacgcccagtccgattttatcggcggtagcctcaatgccggtttgcggaatgcccgttgcccggctgtaaaaagaaccgtaatcccagaatccatcttccgaacatccgaggcatccatgacccgactggataggaaaagacacgccatcattccagcgaacggttgaacaggcgttataggtagtcgggcctttacagcccatcttgtacaggcaatacccttttctggcgccttcgtcatcccacgcttccacaaactgaccggcatcgaaatgcgcgcgtcggtaacatttgtcatgaattcgctggccataaaacattttgggtcgtccaagacgatcaaggggagggatgcgatcaaatgccagcatataggtgataacggcggacatcacttcaggtataggcggacagcctggcactttaataatggttttatcggtaattaatttgtgaaccggcgtggctttagttgggttgggacgggctgcctgcacgcagccccatgatgcgcaggacccccaggcgataatcgctttagcatccgcgctgacgcgttttaacttttccaggaacggctcgccagccagtatgcaaaacattccatcttcattcagcggcgcgttaccttccacggcaacgatataatttcctttgtactcacgcatcacatccgccaacgcctgctcggcttgttgccctgcggcggccataatggtgtcgtcataatccagggaaatgagcgacaaaatggcatcttttgccaacgggtgcgcagagcgaatgaaagattcggtacagcaggtacattcaagaccatgcagccatatcactggcgtacgcggtttattctccagggcataagctatctgaggaatcatcgaactgctcaggcctaaagacgttgcggtaaggctgcaaaacttgaggaagctacgccttgtcacgccgtgtctacgcataacttgataaaatgtatcttgtgtttgcataacgtttatcccaaaccactatagttagtgtgggcatcatatgttgcatttcttgtctttctcaacgtgttttagtagcaattatgtttctaattcgtaacaactgattacatgtgtgctactcacattactcaaaaacataaattaatttaatgttattggtgatgtggagtaaatatagcgttgtgaagatatctcttaatgttgataagaaaccgtgttttttatttataacatgatgggatttttttaaatggtcacacggataacgcgtttcatgttagttcgctgtgtttaactctcctttaaacccgtcagttaaatttattagcttgtaaaataagatcacaattaattacgtgctgcataaccattgataggtttaatttaatatattcatccaatccattttacaaacaaggagagcatgatgaaaaaaagtaaagcaatgttatttatcgctccggcgctgttttcatacgccatggctgcacaggcctgcacaacccttgctattcaggataaacaaggcgatatttttcatgggcgtacgctggaatatatgcaggatttaccctcatggttaacgtattatccggcgggaacgcagtttgataaaaaaacgccggatggcagccaggggataagctatcaggcgaagtatccgatactggccattacttccaccattactgatggcgatagcagagacatacttgaaggcatgaatagcgcgggattgtcatttagtgaaaacatgatcatgaatgcgcagttgccgccattgcccgcgagtgaatataaacaggcaattcctgtcacctcgttgggagaatgggcgctggcccgttttgctactgtcggcgaggtaaaacaggcaataaaagagggcaaattctggtcaccggaactgcatcggtttggcgatctgaaatcgccatttcattacgcgttttacgacaagaaaggaggaagcattgtcgttgaagtggaaaatggcaaattccatgtctatgacaatcccactcgcgtgatgacaaatggtcccgcattcccctggcatctgacaaatctgaataattatacgcaattaaccaatgtggaccgctcttcaggcacattgggcgggataaaagtgatgcagcctgatagcgggattgctattgcagacttgccatcgtccgatacgtcggtttcccgttttatacgcggcgtttattacaccacatatgcgccgcaagcgacatccgcccacgacgcaatgaatacgcttgcacatattatgagccgttttgatcgtccgaaaaatattacggttgattatatggggagtgaaggggaaggcaacgccacccgcaaaccggtctcagaatatacggtctggacaacgctgtctgacttgacgcacggtgagatgatggtgcgcggctacaatgatatcaactataaaacctggtccctttctcagtttaagaacgcgactgcgcccgtgttcgagaaaatcaacgtcaaaggataaaccgctcgtctctgtttagtttccccggtagtctcggcgaaggtaatggagactaccggcggttgcttctctttatcatgcacggtaattaattatcacgatcaccagcgccaggatggtatgctaaatccattcaaaatcccctggatatggattggagggcgcatggttatacctgaggtcaggcaggagaggctctatcagaagatagccaacctcatcattaagctgatcaatgataatatttttccaccgggaacttttttaccgccagaacgcgaactggcaaaacagcttggcgtgagccgcgcctccttgcgagaagcccttattgtactggagatctccggatggatcgtgattcagtccggtaatggggttatcgtttcagataaaaaacaccttgccagtgactataccatcgaagaaattctctctactcgcgagctggtcgatagccattgtgcgcgcttagccgcacaaaacgataacgttgacgtcatcaaccaaatagaggcgatttatcatcgtatggatcaagccattaacgataataacgtccacggcttttactcgctggataaagagtttcaccttgcgatctctgaggccagccgtaaccgggtgttgtttgatatgtcccgtatgttatgggaacaacggattaatatcccttacgccgggcttgatgaacagtctggagacagaaatgttttacttaatctcaacaaacaacataaagcgatagtggatgcgatgcgccagtctgatgctgacagcgcttatgagggatcgctggaacatttacgctatgtgagaaagattgtcggcggctaagtttgtcggtaaataacaccgcatggcggatatgccatgcggtagaactcgccgtaaatcaatggaaaacagcattaatctttaagtaacgctccggatagcgatcaagttctttaactgcatcagggatctcatcaagattgacgaccttactgacaacatcttgcggattaatctccagcgttgacagcatgcgtaatgcctcatcaaattcaccggcactggtgcgggagccgcgtaaatccagttctttgtaggtgatcaggttcgtcggcagcgacgtttcctgttttggccatccggtaaacgaaatacgaccagcaaacgatgctaaatcaagcgtatttcgaatagcgctatttgcgccggaggcttctatcacgacctgcgccatggtgccgtgggtgatatttttaatagcgtcgataacctgatcgtcagcggcgttcagtacataaggaacgccaagcttttgcgcatagcgtagcctttcttccacaatatcgatcagaataggcgttgccttgtaatgacgcgcgcttaatgccgccataagaccaatggcccccgcgccgatgatggcaacatattccccggccttaacgtttgcccgatgcagcgcgtgtagagcgatggtcagcggttctgccagcggcgccatttcagaaggcacattatctggtattttatgaattaaatgtgcgggatgagtaaccacctcctgcattgcgccatcgatatgcacgccaatgacatttaaattttcacaacaattagttctgccgacagagcaagggtagcagtgaccacaataaatataggggtcaacaatcacgcggtcgccttttttaatattgtccggcattccggtgccttcctgaagaacaattccggtcacttcatgcccaataattcttgggtaagtaacaagtgggttcgttccacgaaaagccccgatatccgatccgcaaatgcctgcggcatcaaccttaattaatacttcattttctttcttatggggataatccacccagcgggtttcaacttcaccaggcttattaatgaacacagctttgactttcattggctttgaatcctttactttttacaaacacgaagaccaacaggcttgaaacgatagcgatagcaccagccagatagaacgcatagtcatatttaccgctaaattgaacgataaaaccggtgacaagcggaccgataataccggatatattagccaggccatgcatggctccgccgacgctccctaccttatctttatgaacaacatcctgaataaccgcccaataaattgggcctgttaaatagagcaggaagagtgaaactgacatgagcgtaattgcgctaccaatagtgctaacggtaccggaaacggcaacacataccgccgcgcctgccagacatacgcccagaataagtcgacgtgagagcagggcattaccggtaatccgataaattacatcagaacagacgccgccgagcaccataccaatggcgccgatgacccagggaattaccgtggcgatactaatttctttaatatcgagatgtaacgaatggttcagataacttgggaaccaggtcaggaagaaaaaaagaatatagttgtagctgaaaaaagccagagttgtcgcccataccattggttgtttcatgtaatagccgagtgaaggcgtagcccggccatcatcagataaaataacgtcctcatgattttcaaaatcaatgcgttcttccggcgccaggcgtttactcattgttggcttatcgctaacgataaagtaccacagtagtacccagaccaagccaaataagaaaataatgccaaatgcggggcgccagcctaaggataacgccaacaggcccacaatcggcccggacaccgcgccgccgagcggggaaccggcgctaaaaattccgatcgccgtggcagactcctttcgggaaatccagttattgatgattttatttccggcagcgctgaccggtccttcagccataccgaaaagaacgcgcacgataagcattgtccacaatccggtgactaaaccagttaagccacaaaatacagaccatagtaacgctgcgatgagaaaaaccgtttttggcccaactttatcgctggcccagccatcaataaaattaaacagggcgtatccgataaaaaatgcgctgaagatcattcccatctccgcggcgttaaatcctaactccttttcgatcaagggggcagttatcgacaatgctgaacgatccatatagttgagcatgtaaactataaatagaagaaaaacgataagccatcccattgtttttcttttcatgattaatcctcttattgtggtctagcggcctgaccacaatattttaaggttattttcaaatcacctatcttgtggttagaacgtgatcaatataacaaaaatttatcgcagaggatttttatccatcgcaagcgtgatggataaaattatttaaaatcagacaattacttgaaaattcaatcggggctatcgttttcccctaatccacgccccggtaacgtttgacatgcggcgttaacggaaggtggtgctgtctgtgggtatttttcatcgggcgtaatataaacctgactcgtggcgacatagccatcattaaaagtggcttcgatataggtagcttcccaacctgtcttcggttcatttaacgtaatactgatcttattgttggcgggaatatctattgtaagcggctgatagcggatgccacaggcataacggaaatcacgcgcatttggattgttggctgtccagcgaacgacttttaccggcgcttctgagaaatagaccgtaagaagatggtggtgaataaggccgatcaactgcggtaatgtttttttactttgaaaccggttaataaatggaacgaggcttccttcagcgaactggttaattgagtagtggttcatattaggcactatacgtaatgattttacgccaggaagtttgctataataaaagcgagtattgtctggtacgaagaaatcatcgccacttgcattaataatatatttcggtattgcaaggcggggttggtaaatagtattgagatatcttaacggatctattatttgccttagctgggtaaatgtgggggattttattttctcatctatgccttgctggtagtaggggtagaatgtaatgggccaatttccaccgtatgattgataaatatgctcaagtgaagcatcaatatcaagtagatcaatggcgaagggaacaattgcttcaacatcaggatcggcaatagctgacaaccaggtggtccacccacgctttgaaatacctgtaatgataaaggaatttatattccattgcgttaactccttttttgctaatctcatcgcttgcgatatggcagtgaccataggaatatttaaaggcattaactcacgttgctccggcgcttccataaataatgcccagcttcgggaaacgctctcgtcctctttcagtggttttttatcatcctgaaaggttaaatattggttaggtatatcactcactgatattacgatggtattcgtatcacgggcgatgcttgccagtgtttgctgagtaaaatcaacgggtttactggggatttgtatgcctttttcataattaattccgttgtttacaaccaccaaagcatggtgctcttttgccgtttcagggatataaatatcaacgttatgtcgccattgcgcaggggttaccatgtcatctggcgaccagtgttgcgataataattcatagtgtctgactaccacctgtgctaatggagctgtactaattaaggtatattttagcggtgtgcctgaaatctgctcccggtagtcggggagaacatgagacaaatcacactccgggctgtttcgacaaaagaagatgttgttatgaagtagtgtataaacttttgtagaaataaaaaacagtacgataacaacgagatatatttttttcatgctttccccgcgctttacaagggcaaatgccaaccagcataatttccataaatacctcttaaacattcaatataagtacaatacttttgataaataagggaagaagggagtaataatgcttgtgacgttgtcacattattctgtttctggtttcgctattagcggtgaactttttgaaaggtaaatcattgccgtcaccagaccaataatggcgacagagatagctataccgatccagacgccatacagggcataacccaggacaaatccgcccaatacgggggatataaaatcagcgattgcgattaatgcctgcgccgttccgatgacgataccttgtcgggcaggcgatacatggacggacaaggcggcaagataagtgggtttggctagcgcatcagcgatgctaatacaaacgatagcaaaaataagcactggtatggtcgtggcgatacccgcagtgagaaatccagtacaaagaagggcgaagatgaggataattagctttcgctccgaaaaatattggctcacccaacctaacagaaatagctgaacgaaaatattaataaccccgtccgccattaacagatagcttaacgcttttggcccaaagggaagcccattccagatgaaggtgtcagaaagaaaaacaggtaattgtgaagagtacatgccataggcgaagaaatgacaaagcattacgatgattaagacgcgaaggactggcatctttaaaatagcgcgggcagagaacgacgctattttatctgtggtacgtgatgttgtggaagggtcttttaacccccaaatcgcgaccagggcagccccaaggacaagtataaaggcggcgtagatcggcgcacccagactgatacgcgatagccacccggaaacgcctgccccgacaataccgcctaaaccaatgcagcctgtgaggataccgattgcctggcgccgatttctgacgtgcgtacaatcggcaatataggctgcggcggctgacaaattcccggcgctaatgccaaaaagcgtgcgggcgagcaggataaacaggatacattgcgcgttggcgagtaatagtaaacttatcgccgcaatagccagcgtgacaatcagtattcgcttgcggccaacgcgatcggaaaggtggccaatcaggggcgctgcacaaaattggctaaaagcctcagtggcgatgatgattccaatgataagcggcgaaccgcccatctcgcggatataaaaaggcagtaccgacatcacagccgctgtactggcggcgtaaaggccgacaagcaggaaaacaggcaaaatacgccgcttgttgagcggggtgatagtttcgctgtcggtgttctcatagacattagtattcatctttaatccctatggcaaaacgagagagataattttcaatatcgttgctctgtttgccgtgaaagaatgcgccgacatagccatcgggtcggatcagcacgcattgacccggggccagatgataggactcccggaagtgccccagggtatcgatgagctcgtcctgctcgccaatgtgatgaatacgcagacctcgccgcgcatcgatgaccttaccgtgggtttcgtaggccaacagattccagtccggaccctggagtaactgaaataatcgtaatgattggccgccggcgcccaaaagaggagcatccggagctctttctcccgcttgtaacccatgctgacgttcgggcaacgtgtgggctaagggggagttggtatactggatgtcaagttgttgaacgtcgcgttctcgtttgatgccaccctgtttttgagagtcaagtaatcgggtagaaaggtggagcagtgattcggctaccgggcggcgttcctgttcatagctatcgagaagctcttctcctgcgccccgtagcgaggctgccattttccatccctggtaagtgaagcgtcagccacaagcgcatggattcccaacgtacggccggggaagctgacgcctaatttctttctgacaaagcttccgccgccatccgcgcctatcaaataatgcgcgatgatgacctcttctccagttggcccggcaacatacgcggtgaccgtgcgtggggtttgcgcaaaatgtcgtaactcgcagccgaactccacccgatgtccccatgcttttaattgctcccgcataatcgtttctgtcacgttctgtggaaccatcaatggcagatggtagggttcggcgtgggtcggttttgtattatgcgcaatatctgaatctacgtagcttccgtcatgacggtaggttcgtaatcggggatagagcccgccggcggcgaccactttattgagtatcccaatatcctcgaagatttcttgcgttcgcggctgaatacctttatcgcgggaaccggtaaaaggcgtcgctcttttctcaatcaggcgaaatgagaccccgtgacgcgccagttcgatggctaaagtaagcccggtaacgccagcgccgcagatcagtacatctgtagtggtgtatgttgtcatcgtctctccaatatgtgtattatgcacataagaggagacatgctatgtcagaaaataaaaatgtgcaagatacacatatttccgagcaaatgaaggcacttcacggtgcgttgattcgcgtggtgagcgcgctcaaccggcctcgtaatgatgagaaattaattgcagaggcggggattcaactcgatcgcgcgctattttcgatccttattagtatcgaacgtttagggccgattggcgttgttgagttagccgaacgtgccggtcgtgattatacgacggtaagccgacaggtcgccaaactggagaagttgggattgataatacggcaacataatgtcatcgatcgtcgtatacgcgaggccgttatctcccggacaggaaaggcgatgacggagcgtatagacgctgcgcgagagcaaatgggcaacgttgtttttaaagactggcctcaggataaaattgatatctttgttcggttaatgcaaaagtttgccgatgcaatggatagcgatgcttcaatgccggaataagcaaaagaaaagggcggtcaaatctgatcgtccatgctactgcattaattaaatagccagcaaagtaaatataataacaacatttatcgagttaattttcaccctttgaaaggccaacgtatactgcagaatacggctatataacaatcgccgtatcaatggtttttcaaagggtaaatatatgcttaccgaaaaatatgattttcgcattaccgatcagatgactatcccactcagacctcattggatagccaatgattcatacagggaaaagtgcaaaatgcttgtcctcaaccgaagtaaaggggaaattcataaggtagactttagtaaagtaacagattatatcaaagaaggtgatgtaatctgttttaacgacagtactataataaaccatatgtttatctgtaaaacaagacgaaatagattaattaaaattgttttagagggatttttactaaataatagagtaattatttccggacttttaaaagaaaggcttaacgcgaatgatgttttctatttggttgataaccctgaaatttccattaagatagagcaaaggtttggcgaggagagccagtaccgggccgttgtagaaaatcatgaggctttaatttgctatttagccagtcatggtgagcgtcttgatgagtatgtggactccagcttgttttataaatatccagatgcttaccgttccgttttttctaaaaagtatggctctttggaaataccttctgccggcattcattttacctgggatcttatccaaaaaatcaaagataaaggtgggttaatatcttttattactttacatgttgcatcaacagaaatgttgtccaacagaaaaatacaaacaaaatgtgtagaggaagtgactatcaacgaagaatactacgaggttccacaagctacagcggatatcattaatactgcgaagcaaaatggcggacgtatttttgccgtaggaactaccgttacacgatgcctggagtccgcgtattcgagggaacacaattgcctcaaagcaagttctggctggactgcgctttatatacatccaggctatcaactgaaagtggttgactgcctgctaacgaacttacatcagccaaaaacgacgcatatggtgttaactggtcagtttgctggggttgatctactcatgaaggcctatgcctcagaagatatccagtcatgtcagttcgatatgtttggtgattgcatgttaatcatacaggatgaagggcagggatgaataaaataaaaccggtacacataatgctaccggttttaccgagaataagcatcaggggattcgggcaataacctttatttcgaaatcaaagccggccagccaggtaacgccaacagcggtccagttaggataagggggataggcaaatatctcctgtttcaccgccatcacgtcgttaagttgtagacggcatcattttcacgctttccaacaccaatgacagttaccgtgataatttcatcttcgacgctgtagaccagtctgtatcctgcaccacacggcttaattttgtacttaactgcttgtatcgattaccaggaacgttaacagcgtgcgcaccagcttgccattgtctaattcaagcacacgacgaacaaatgtgttataacaatcctataaagtggttgcattgccaatgcataaagttaatttaatcaggaaattagagtatggatacagttgaagagcttaatagcacttatttttatgccggacgttcaaatctgactgctagtcagttgctgtttatgattttctgcgaaaacactgccaatcagttgggtgttcaggattttggggcgatagtgtctattgtggctggattgaatgttttgcctacgcggacaaaaccgcgtggtgctaagcatttgcttaatccgtttcgcaaaaacgatattcctcaggcgccggagttcacgataggtatgctcattgcgtctgccagggctggtcgctggttgtatgactgattcacgcttgggggctgctttccgttctccatcatcatggagcgcataatgtatattatgttaaatgcaccagaacaattaaaagacatgttaaggcggctggattcgtgcatgtcaaaaaacttctggcccataagtttgatcccttccctgccgtgacgctgcgcgaattctgttgatttgcacccgcttatcctgcacacgttttccttgcaagtcatgccttgagattcttagttcatgccttaaggattccagttgacctctttctctaatcttttttaattccagatcggaaagcgcagtaaggaattttacttccgcggctgatagtcccattgtaatcgcttgctcttcagaagaaagaggatttaatttaccataatccttgaccaactgctccgtagtccattcatgtaaaaacatatggttactataaataaccggatcaatacctaatagtgttgccgataattgagttgatcgctgtgcataaattgcaccttcaaccttacccagtaaggttcctatagctgacggcagatcgtaatccagaagatctacctctcttgttgtaaaactctttaaatctgtatcgtaaacccagacctctttttcgatgttattgaaattatcaagcaatgtttttaataattctttatttattaggatcttctggaatgtttcttcatttctcccaaagtgctcaagaaacgctaaataagtagcgtaatccatttttctatctttaaaaaagagctgacttagaaaagcggcagattgttcatgattgcgttctttatcaaaatccagtaattcaggaacgattagaaaaattggataatcatcatcaatagtcataaatgggatggcgcgaaatagattggaaacatgttcaagtaataccaatctgcgcatgcggacataactattatctggtggcaatgacaaaaatgaatgcagagagctaagagaaggaaaatgtaatggatcaaccattatgatgctatcaaaataaatccccagagatctaagatgattagatatgttataaccaaaccgttgaatcggaagtaataatcgataacttttagacgcccgcacttctgttataagcgccgcggcgtgagtatcccaaaatttatttagcaacacgattaggtttgtaagttgattatctaactcgggagagctaattagctctttcagaatgaatctacgtaattctttcagttctaaatttctaaatgcatatttatatttttcagaaaaagcgttttccatcaataaaacatattcattctgtatgctttttgtaatactactaccttactgaccggagctccattatgagtgcatcacaaaacaagaagaaaacgctgtcattgggtttagcgctaatcccagtcatctccatgttgttattgttgattatcggttacggcatcatggggctacgtatctattttgattgcagccttctttttaaccagcgtggtctccgtctgtaccggtacatcgtgggggtccgccgggacggttggcgttgcgttaatgggggttgccgccgggctggacgtgtcgcttgcagcagcagctggcgccgttgtttctggcgcttatttcggcgacaaaatctcaccgttgtccgactcgactaactttgccgcgattgtcgcagacactactctgtttgagcatattcagcatttactttggacgaccctgccaagtttcctgcttgccgccgtggtttatcttatcgccggacacagtaatatgctgggcgaggtggctacgccgcagcgcgttacggacatcatccactcgctggagtcgctataccattttaatattgttcttattttgccgccggtgatcgtactgtggggcgcaattcgcaaaaagcctgtcatcccattaatgttaagcgcctgcgtacttgccttgttcctcggcgtcatcatgcagggactgagcatcaaacagggactggacgctttcattgatggatttgatatcgccatgttcccacaaggcgcagaaggtgtgcaacaatactggttcggtaaagtgggattttattgagcgtcactttggcgacggcgctggaaaactgctgccgatgtgggtttctgatttcgattttgcctgcccgccagaggttcaggcggcattgcatcagcgaatcgagcacggcgtatttggctatagcgaacgtgatgaggcctattttaacgccctgcttcactggttttcgtcacgccaccagctcacgttaaaacaggaatgggtatgcagcgtggaaggcgtcgtaccagggttggcgctcttagtgcaaatgttgacgcatccaggcgacggcgtagtggttcaggggccatactatggctccttcgccaaaataatcacgcttaatggtagaaaactgctggagaatccccttagcgagtcgccggatgaaggctaccagatggatttttgccaactggaaaggctgtttcgccatgagcgccctccgctaatgattttgtgtaatccacataatccaaccgggcgttgctggtcggccaacgagctggagcaactgcttttattatgtgaagcttatgatgtcactctcatctcggatgaaatatgggccgatctattgctgccctgcgaaacctttacctcggtactgcatttaggggagcgctggcataaacgggtcatctccgccactgcggccagcaaaacgtttggcttatcgtcgttgcgaatttctaattttctcattcccgatcctacgcttcgccagcgtttcctgtctcgtctggacgctcatgggctggatgtctttaacgccctctccgttcaggcggcaactaccgcatggaatgaaagcagacagtggctggattcgctactggattatctggcggaaaaccgccgctggtttgttgaacaggcgacagagcaccttccctgggcaagaattgtcccggcgcagggaacctatttattatggatggattgtaaaaaactgggactggatgacgaacagctaaaatgggtaatggcggatgtcgcgggtattgctccttcaatgggcagcggctttggcccggcgggcagcggatttatccgtttaaatctgggatgtccacgtacctaccttgaaatggcaatagacggcctgaagcgaatatcggtgaagacaatcaaaggaataccaacaggcggatgaatttttcgggcggtaaactgacaacggtgttatttctgcggcatgatatcgcctgagcgccagtaaaaaaccggccattaaggccggttgggtccggagcgcagtttcactatcaggggcgtctgaataacacgatgctgcgcccggccagatcgaaatccatttcttcggtaatccgcattccctgctgcgcgtcatcggcagtcgtcagttcaagcacccagccgccttctccccacatcggaatacggaacggtacgctgccttcaaacggattgaaaagcagtaaggcgtcatgccagatccccgcttccggctgaagatcgggtcgactaatacatacgcctatcgtcgatccctcatcccattgttcggattactgcgcccctccgccggcgttaaaccagcggatctccagaccgtcacgccagctctcccggcgcagcaacggttgcgtggcgcgcagttgaatcagatgacgggtaaactcccgtagcgcattggcggtttccggcaaattatcccagtggacccacgatatttcactgtcctgacagtagccattgttattgcccatctgactgcggccaaactcatcgcccgctaataacatcggcgtgccgtgtgagaaaagtaaggtggtcaggaaattacgtttctgtcgctcgcgtatcgcattgatgccctcgtcgtcggttggcccttctgcgccatagttacaggagcggttatcattatgcccgtcattattatcttcgccattggcttcattatgtttgtcgttataagacaccagatcgttcagcgtgaagccgtcatgggcagtaataaagttaacgcttgaccaggagcgacggccgcgcaaatcgtagagatcgccggaacccagcaggcgtgcggcgaaatcatttgtgacgttgtcacctttccagtattcgcgaaccgtatcgcgatatttatcattccattcgccccaccctggtggaaaaccgccaacctgatagccgcccggtccgatatcccagggttcgccaatcagtttcagttttgccagcaccgggtcttgcgttaccgcatcaaaaaagccgcctctctgatcaaagccttccggctcacgaccaagaatggtgcccaaatcaaaacgaaagccgtcgacatgcattgactccgcccaatagcgaagcgaatccatcaccatttgcagtacccgtggatgagaggtattgacggtattacctgtccctgtatcgttaatataatagcgatgctgatcgggcatggtgcgatagtaagagaagttatcgatacctttaaatgacagcgtggggccaagttcattcccttctgccgtatggttatagaccacatccagtatcacttcgacgccggcatcatggaaagcgcgcaccatatcgcggaatccctgaataccttttggaccatagtagcgcgtcgccggcgcaaaaaagcccagcgagttatatccccagaaatttttcagtcctttatcgagcagatgctgatcgtccgggaaccagtgaacgggtaaaagctcgacggaggtaatccccagacttttaatgtaatccacgctggctttatgccccatgccctcaaacgtaccgcgtagaggctcagggatcgccgaattaagctgggtaaagccttttacatgcgtttcataaataatggcgttcgaccacggtatggaaggccgttgtctatcctcccagttagcctcagccggatcaatcacccgacatttaggcgtaaatggcgcgctatcctggtcatcaaaggtcaaatctttatcgtcatgaagtaattgatacgcgaaatgcgcatcgttccactgaatatcgcccaccagctcacgggcataagggtcaataagcagcttattggggttaaaacgatgaccattttccgggtcataaggaccgtaaacgcggtacccatacagcgcgccgggctgcaacttcgtgacatagccgtgccatatttcgtcggtatattccggtaactccagacgagcgatttcatgctccccactcggatcgtaaagacaaagctcgacgcgttccgcatgggcggaaaaaatagcgaaattcacgccttcgccgtcataattcgcgccaagcgtatggctgtatcctgatctgatttcaaaagccctgtttgttgtcattctctttctccacccacggtaaacgttgtcctgtcacggcacatcaacacataaactcagtcgctcattaaaaccagtacgccgccctgatgtgaggccaacgacaggcgttcaccaggcattaacctctcctgggtaagcacattgcgataacgacgctgattaagctgtccgggtataataatgtcggttcctgaccagaaaccgctatgcgattgtgataataagccgtcacattcggcgaacaccagtcggggcgcaacaacaatcagcgcatcatcatgattgactctggcgtaagcgatgaccttgtcggcacgctgaccaacagcccgcagcggtatatagtcgccaaaacggaagagctcatgattctgctgacgcaaacgcagtaaggcggcggtggcatactgattcacctgcccgtccagccaactctcttcgcgcgagaaaactcccggcgtcagttggtctaactgctgcgccagcgtggcgaaatctggttcgcggcggttgtcgggatcgacaaggctaaaattcaacgcctcgctcccctgatagatatcaggtactcccggcgcggttaatttgataacggtctgcgtcaggctgttaaccagtcctgcgcggatgaagggttgcaaggaacgataaaaatcctgcaaaaatgtctgattatccggcgccagtaaataacgggcgtaatcaagcattgccgtttcgtaagcctcattactgtccacccaatcggtacgtagcttcgcttcgcgtagcgctttctccacaaaggcttcaaagcgtattttcagcgcgtttaaacctgtttcgtcctgtggttgtagcatcgggggccagacgccggtcagcgcctgatatagcatccacgtatccgccgattttggcgcagtgccatcattcaaaaatttgacatgggtctggttcatctgccgccagcgggcaaggcattcgctccactgttccggcgcttcggtaagcgtatacaggcgtgctcgcgcatcctcgcctcgcttggtatcgtgggtcgacgtaccggataacgcatcaggctgtcgcgcctgtcgggttttcatctcatggtgaaagcgttcgatggagaagtgatgcgtgacgggctcggcgccgacttcatttaacgccagtcccatgttttgacgaaagaaaagcgtatcctctaccgatttcgccatcagcggaccggtgagttgctggaaccgaacgcgaaactgtgtcgcctcctcctggctggagacgggaacatcgccggtaagaagacggctcagaaatgtaagcgcttctggctgcggagggttttcaagcgtctttacccgttccacaatacggtgtaacaggcaaatatcggtcggcggtagcccttctgccgtgccgtaagtgcgatatacgggaaaggcaattaataactcgcgtaacgcctgccgaacgacgctctcttcctgtgcgatctgtagctcgctggcaatcgacagcgcaagcgcgagcagccgggtaaattccccctcaaaattgcgatcgaccatcagcaatttagccgcccgtaattccgcccgcatatccactggcgcgcctgttacggtctcgtaagcctggcgcagattgtctatctgcttatcgtcaaccagtacttccgccagcgaggcgatgaattcatagcctgtggtgccggaaaccggccagtcatcaggaagttgctcgcctttagcgagaattttttccacggtgatatagcacgccggtcccacttcctgacgtaaacgcgcaagataggctttcggatcggcaaggccgtcgatatgatcgatacgtaaaccgtcaaccgcccccgttctgaccagctccagaatcagccgatgtgtatcgtcgaagacgattttatcttccacccgcattcccaccagccctgtgacctcaaagaaacgccgatatgaaagcgagcgagcggcatcgcgccaagacattaatttccacggctggcgctcatgcaaatcagcaatagcggctttatcggtaagcgccagtatttcagcctcgcgcccctgccacgtcgctggcgcaagcggataataattatcataataggcgaacgtgggtttacccgtaacgggatccggcttgatcgcaatttctccgtttcccagcacggcgtcaaacgtgtcgcctaaaaaaggcagcgtcagtcggcgcgaccagtcaatatcgaaatggcgcgcgtaacggctctccttgccatattcaagcacgtcgcgccaccaggcgttttccagcgagctggccatgtgattaggcacaatatcgatgatcaatcccagaccttgtgctttaagttcagccaccagtctttcaaatccttcgcgcccgccaatagaaggctcaatctcattcgcatcggtgacatcataaccatgcgttgacgctttggtggcggtaaagatgggtgaggcataaagatggctgatacccagatttttaaggtaaggcaccagcgccgcagcgcgatcgaaggtcatgctattgcgaaactgaagacgatacgttgcagttgggatcatgatgcagactctccctgggctaagcggacaataagagaatgttgggaaagcgacccggtggattcattcggccaggcgaagagagtcttacccggtaaatcgggcagcaataccgtcgtggcgctaatattcagcgccagtgacagtgttcctcccggaaaacgccagctaacggcaataaacccgggcgcggtttgcaataccgttcctgagctctcacgggcagcggacaacagcggcacgatatgcttctggcgcaaaagcagtagttcgcgggtaaatgccagccacgctttaccctcttcactgtgctgttgcttccagttaagttttgagcgttgaaaggtctctggcgcattcgggtccggaacattttcccctgcatgatcggcaaactcttttgcgcgaccttcacgaacggcgcgggctaaatccccatggaaatcggtaaaaaaaagaaaaggacggctttcgccatactcttcgcccataaaaagcagaggaatatgcggtgaaagcagcaacgtggcgagcaatacttttgttcgttcagcacccgccagggttatcagtctgtcgccctgggcgcggttaccgacctgatcgtggttctgaataaaatccacaaaggcgaccgggggttgtccggtactttttacgccgcgaggttcgccggtttgcggtgagatttccccctgataagcgaatccttcggccagcgctcttgcgaggtgtttttccggggcatcagcaaaatcgttgtagtaggcctgggtctctccggtcgcaaaaacgtggacggcattatgaaaatcgtcattccattcggcggtaaacagcggcgcattgccatcctgatcacggggatgcagagaaataatattgcggctatcttcggtagtcagatgaatgggtctgtcggtaatgtcttcccgaatacgttgtgcgatttcaaccagcacatgcctggcgctactgtcctcaatctgatcgatagcgtcaaagcgtaagccgtcgagatggtattctgtcagccagtataacggcgcctcgatgatatagcgccgcacggcgtcgacatcataggcgataccatttccccacggcgtcatgcgctctttgtggaaaaacgccggcgccaatagcggtaaataatttccctccgggccgaaatggttcagcacaatatccaggatgacggaaagaccatacccatgcgcggtgtcaataaacgctttgaaatcatccggcgtcccataggcagaatgcggcgcgtaaagcagtacgccgtcatagccccagccgcgctcgccgccaaattgcgcaacgggcatcacttcaataacggtaacgccgagttcagcgagataaggcagcttcgctattgcggtgtggaaggtgccttccggagtgaacgtgcctgtatgcatctcgtacaccacggcctgctcccaacggctgcctttccacccggtgttgcgccacgcgtagctgcctggatcaatcacatatgacggaccattgacgtcagttttttgggcgcgggaagccggatcggggagcaccatgccatcgctgagtacaaagttatactccgtacctggcgtcaccccggatacatccagcgtaaaccagccgtcaccgctcgcctgcatttcctggtctttacccgcaagcctgagcataaccttttgctgaccggtggcccaaagacgaaagcggacgacatcagcggcgatatattcagccccccagcttttgcaaaaaatttttgaactcatttgtcgctccgtttaactcataacctctacagcatccgaaaaacaagcatagactatggggctaatttttacgtgacactgtcacttaacaggcattctttttcctatctgcgtgtaaaaccgtggaattattgtcgggattgctcagatataccgaagtgcgcggtatcgcctcgcccgtgttcgccagagccctgaacacgctgtagctggataacttctccctgctcccaggcgttagcccccttgataacgggatgttcaggcagatcctgccgctcgcgtttaatggcctgggtatcaatccccagacggcgatcccgatcggccagcagcgcggggtcaagctgcccgtcgccggtaaagcccatcatcagcgcagggatacccattggcagggttttatcccggtcggtatgccaggtgtgccaggtcttgccataagtattaacaatcttactcatcaacgccttatcagcgacctgcggtaagcctggcgccaccaggctaccggatttcacctcgtactggtggctgtgccacagttttttttcctcgggaggaagcgttttaaataaacgttcgctgataatgtactccacccccatcaggcgcgcgtttttcgtattgccgtcgtaaatcaccgcctgcatgacatcttcgttcaggacggtaacgtaatggtgcgcttccatctgtccgtttttatcaccgctataaaaatggaacccgtcaaggtaggtactgatggcatcgacaggtggtctggattgaatagccgccgcgcctgtttccagggtacgtaatttggcagatgttttttccccgggaataggcgtttgcggcggcgtattattggcgccgcatccggccagaaaaggaatgataaagagtgccagcggtaaaattttcattaggtctccatatagtgaaagggctctaatgaaaatagtgcaataccacgtgattggtagaagaaatggaagatgctatttgtgacggtgtcacaaatagtaaaacccgacacacaggccgggttttgatatcagtttactcttattttgagagttctttcttgatttcgtcttttattttgcttaattcactctgcgggtttttcttacaaagctcaacggctagcggcactgctgtcgtctcagtttcctggaaatcaacgtagtccccgcctttaaaatcttcatcttcattcagcacccagaaagcgactggcgccatcgtctgcggattgaggtcaacaaactcctggcagctcatacctttaggcgtaacgtttgttttagtagtatctgttgccgcattcacgctaacactggttaccagcgctgccacgataatacctgctgtagcaagggagaatttattcattgttgttgctccaataattatataaataacctctacatctgcgcgttaacccgttaatgtagaacgcagaaaataataccccacctctctcaggaataaagatcaccctccgtgatatggctattattgatatttacgttgactgattttgatgtttgatgaataaagcaacatggcgagcagattttagggcgaaaaagtagaccacgacaacagcaaatgacgagtatgcgctacgttgagctgatgaaagagaacttcgctctgacatgccgtcgcaatcgcgcgccagccagacacaaacggtgggcagaacaaacatcgtaaacagattgcctgtcagcatcccggaggcaaccaccagccctgtccaaaacggcttgcggtgtctacaccgctggcgaaccttatcagggctaaaccaaccactattgccccggtagtcatcagcaccgggcgcaatcgaatctacaatacaatttcatagcatttacagatagtcggacaatttcaggtttccgtaatcataaaaataccttttgcacacaaactgtatacttccagtagatttattgttatttagcactataactgcaagcagttgaatccaaagggtaataattcaggtattatttggagggaaatttatataattaagataaataaatgcttatcggttaagtgagcgacgtttaagttttgttgcaaccacggctttatactttttacgagtgctattttttttggctaattaaaaaggtaaagttaatgaaactatccgtaacattggcgtttttcggttacatgatggtatccagtatggcacaagctagcgatatcaatatgtggcgtgaacccaaacctgttgtgaaagagggtaaatattacagcttaatcatggatcgtggcgagttgcaaaaagcagtaaaaagcagcagcaataactatctcttttccgaaaaaggtgcaggagtgaagccgctggtattgatcggctctccggtagagattagcgaatttatgttgcaaaataaaactcgcagcattgaaaaccacattaaaggtctacctgacatttatatgggagtgacaaaatataaacccaaacaacgttttaccggcttatttccgctacaggatatattgactcaaactgttgatcaggtatcgaaatttgtgcccggtaccgatatcaccgatgcggtgggaatcccctccgacctaaaagcattacagcaagccattttggctatgaagcaaaaagataaaatcagcaaaaatatactgtacgtcaaatttagctacttgccggaagatggaatggtgaaagtaggaagcaaaacagtttcttttggtcgtattctggagaaaatgcagcagagtaatcgtaccctgcgtagataagcaggaagcaggcagtatttccagcttctggaatgttaaagctacaaaagttgtctggaggtaataggtaagaatactttataaaacaggtacttaattgcaatttatatatttaaagaggcaaatgattatgaccggaatatttgcagaacaaactgtagaggtagttaaaagcgcgatcgaaaccgcagatggggcattagatctttataacaaatacctcgaccaggtcatcccctggaagacctttgatgaaaccataaaagagttaagccgttttaaacaggagtactcgcaggaagcttctgttttagttggtgatattaaagttttgcttatggacagccaggacaagtattttgaagcgacacaaactgtttatgaatggtgtggtgtcgtgacgcaattactctcagcgtatattttactatttgatgaatataatgagaaaaaagcatcagcccagaaagacattctcattaggatattagatgatggtgtcaagaaactgaatgaagcgcaaaaatctctcctgacaagttcacaaagtttcaacaacgcttccggaaaactgctggcattagatagccagttaactaatgatttttcggaaaaaagtagttatttccagtcacaggtggatagaattcgtaaggaagcttatgccggtgctgcagccggcatagtcgccggtccgtttggattaattatttcctattctattgctgcgggcgtgattgaagggaaattgattccagaattgaataacaggctaaaaacagtgcaaaatttctttactagcttatcagctacagtgaaacaagcgaataaagatatcgatgcggcaaaattgaaattagccactgaaatagcagcaattggggagataaaaacggaaaccgaaacaaccagattctacgttgattatgatgatttaatgctttctttattaaaaggagctgcaaagaaaatgattaacacctgtaatgaataccaacaaagacacggtaagaagacgcttttcgaggttcctgacgtctgatacattttcattcgatctgtgtacttttaacgcccgatagcgtaaagaaaatgagagacggagaaaaagcgatattcaacagcccgataaacaagagtcgttaccgggctgacgaggttatcaggcgttaagctggtagtcgagggtgatttccgcattcagaacctgcgataccggacacccggcttttgctttctggatgatttgatcgaaagttgaagcatcaatatctgctaccgccactttgctttgtagcgcaattttggtaatggcgaagcccgcctccaccttatcaagcgatacgtcagcggtggtgtcaatggatgtcggcgtaaatccagcctctcccagcatgagtgatagcgccatggagaaacaggccgcatgtgcggcgccaattaactcttccgggttggttccctgcgcgccttcgaaccgggtattgaatccatacggttgttgattaagcacgccgctttctgttgatacagtacctttaccccgtttgatgtcgccttcccagtgtgcctgacctttcttatggattgtcatttttgctctcctgttggctcaaaaaataaagtatagactatgctgataatctgcgttgttcatgccgatggatgtagcatgttgtcgattacccgcacttcagatatagaaaatagttgtatgctttttcagtgatggatattaaaccaacaggcctccctttctttaaagaatatatccctccttttatccttactttttcttccggaagcgtattccattatgtatattttcattcatattaagatttatcttatctcgttgtaataaatgataaaaatcgcaataagtagcattttaaatgtatattaattgaccactatttgtatgaggatatgtaattggcaaacataatatattttcttctggggtaaacaattagagttccgccttgcgttaaaataactccaggactaatcttaaccacagccgcaaaaatatttgccatgctgaatacgaattaattttctgcgagccgtactaaataaatacatgttcacggaggcattatatgtttacttatcactcagcaaatacctcagcagcacaaccggccctggtcaacgcgattgaacaaggattacgcgcggagttaggcgttgtcactgaagatgatattttaatggagctgaccaaatgggttgaggcttccgacaatgacatcctcagtgacatctaccagcagaccatcaactatgtggtaagcgggcagcacccgactctgtaaaacctgctatgctgtatcggcaaccttaggggttacgtttctttcgcgtaagcgaatttgtccttaaaactagcaacaggattgaggagttaacatgaaatcgaaccgtcaggctcgtcatatacttggactggattacagaatttccaaccagcgtaaggttgttactgaaggcgacaccagcagcgtggtgaataacccaaccggcagaaagcgtcgcgccgatagccaaaagtaatcgtacagtcctgaaatgacgttaaacaccattgcatctgcaatggtgtttttgtttataggaatgaccttaacgtctcacaatgctttatactcagggtcggttccctggtggaaggcaatatatgatgataaacgacggtgccagggacagttattcgaaaaagagtgagcaacatggaaactacaaccaagaaagcacgttccctttatatcccttacgctggccctgtattgctggaattccccctgttaaacaaaggcagcgcttttagcgtagaagagcgccgcaacttcaatttgtcaggactgctgccggaggtcgtcgagtcgattgaagaacaggccgaacgcgcctggctccagtatcaggggtttaaaacagaaatcgataagcatatttacctgcgtaacatccaggataccaacgaaacgctcttttatcgactggtgcaaaaccatcttgaagagatgatgccggttatctataccccgaccgtgggcgcggcctgtgagcgcttctctgagatttatcgccgggcgcgcggcgtatttatctcttatccgaaccgtcacaatatggacgacattttgcagaatgtgcctaaccacaacattaaagttattgtggtgacggatggcgagcggattctggggcttggcgatcagggcatcggcggaatggggatacctatcggtaagctgtcattatacaccgcctgcggcggcattagtccggcctatacccttcccgttgtgctggatgtcggcaccaacaatcaacagttactcaacgatccgctctacatgggctggcgtcatccgcgcattaccgacaatgagtattatgcgtttgtcgatgagtttattcaggccgttaagcagcgctggccagatatcctgctacagttcgaagatttcgcgcagaaaaacgcaatgccgctgttgacgcgctatcgtgatgagatttgctcctttaacgatgatattcagggcaccgcagccgtgaccgtcggtacgttgatcgccgccagccgcgctgccggcagtcagcttagcgagcagaaaatcgttttcctcggcgcgggttcagccggatgtgggattgctgaacagatcatcgcgcagactcagcgtgaaggtttaagcgaagatgccgctcgacagaacgtttttatggtcgatcgcttcggcctgttgacggaccggatgcctaatttattgccgttccaggcaaaactggtgcagaaatgcgacaatctccagcactgggataccgaaaatgacgtgctgtcgctgctggatgtggtgcgtaacgtgaagccggatatcctgatcggggtttccggccagaccgggctctttactgaagagatcatccgcgagatgcataagcattgccctcgcccgatcgtcatgccgctctctaatcccacctctcgcgtggaggccacgccacaggacattatcgcctggacggaaggcaacgcgctggtggcaaccggcagcccattctcgccggtcatctggaaagataaggtttatccgatcgcacaatgtaataacgcctatattttccccggcatcggacttggggttatcgcttccggcgcatcgcgcattactgatgaaatgctgatgtcagccagtgagacgctggcgaaacattctccgctggtgaataacggcgaaggattagtgttaccagcgcttaaagacatccaggtcgtgtcgcgcgctatcgcttttgccgtaggcaaaatggcgcagcaacaaggcgtagcggtgaaaacctctgcggaagcgctgcaacaggcgattgacgataacttctggaaaccggaataccgcgactaccgtcggacttccatttaatacgtacccggcggtgaatgccgccggatatcactttcttctttagttttggtgagtctgtcgacacacctgaattcctttccctgcttatttgtcaagctactaatattagccacctttatgtattgaacgaggatttatcaggataatcctggctaaactattacattgtatttctgccgccttgcataactcatcagaaatattaatcctaaagaggtaatagcaccttacctgctattacctgctatgcagttcactattaagaaaaggagaaggttatgaaagctgctgttgtcacacaagatcatcaggttgatgttactgagaaaacgctgcgtccccttcgccacggtgaagctttgctaaaaatggagtgctgcggtgtatgccataccgatctacacgtgaaaaacggagatttcggtgacaaaaccggcgttattctgggacacgaaggcattggcgtcgtggcggaagtcggtcctggtgtcacctcgctgaaacccggcgatcgcgcgagtgtcgcgtggttttatgaaggatgcggacactgtgagtattgcaatacgggcaatgaaaccttatgccgcaacgtgaaaaatgccggttacacggtagatggcggcatggccgaagagtgtattgtcgtcgcggattatgcggtgaaagtaccggaaggcctggactctgcggcggcaagtagtattacctgcgcgggcgttaccacctataaagcggtgaagatttctcatattaaacctggccagtggattgccatctacggtctgggcggtctgggtaatctggccttgcagtacgcgaaaaacgttttcaatgcgaaagtgatcgccattgatgtcaatgatgggcaactgaaactggccgaggaaatgggcgcagatctgaccattaattcacgtacggaagatgcggctaaaattgtgcaggaaaaaaccggtggcgcgcacgcagcggtggttaccgcggtcgctaaggcggcgtttaattccgcagtagatgccgttcgcgccggaggccgcgtggtggcagtcgggctgccgccagaagccatgaaccttgatatccctcgcctggtgctggatggcattcaggttgtcggttcgttggtggggacacgccaggatctgaccgaagccttccagttcgcggcggaaggaaaagtcgtgccaaaagtcgctttacgtccgcttgaagatatcaacgttatttttaaagagatggaacagggacaaattcgtggccgtatggtcatcgatttccgtcgttaaacgatttgctgtggttctgccagaacgttgacgtttcagtcaccagcggatcgataacgaccagatacttcagtttgcttaagctttgcaccactttgtttttgtccgggaaggacgccaccgggttaaagccctgacagaaatagccggtaactttcccgctatccatcatgttgaaatatttgatcacatcataggactgatcccacttaggcagccaggcaaagccccagtcattctctttctgcgccgcatcgccatagaaagatttcatcaggctgacgaagaacttaggataattcccccagtagttgacctgatcggccagcgtcgctttgggggtattcgcggccagataagtttgcagatcggcctgtttttctgacggtagcgtcaggtagcccggcaggctggtggagagcagtcctaaatccgttaagccctgaatattagagtggccgcgcaaggcgttcacaccgccgccagccatccccatattgccgagcagcaactggatcatcgccatagtacggatgttctgcgccccgacggtatgttgcgtccagcccagcgcatacaggaaggtcgtagtgcgatccggcgcgctggtagaggccaacacctcacacaccttcaggaagtccgctttcggcgtaccgcagatgttttccacgacgtccggcgtatagcgcgaaacgtgctgcttcagcagattccacacacagcgtgggtgcgtcaacgtttcatcacgtttggcatagccgttttcatcgaactggtagttccaggaggatttatcgtactgacgcttttgggcgtcatagccgctgaaaagaccgtcttcgaacgtaaagtcttcccgcaccagcaggctggcgttggtgtaatgcttaacgtattcagcgttgattttgttattttcgatcaggtacagcaaaacgccggacagaaaggtaatgtctgtaccggaacgtattggcgcatagatatccgccaccgacgccgtacgcgtaaagcgtggatcaacgacaatcagcgtcgcatcgttattatttttcgcttccatcgcccagcggaaacccaccggatgcgcttctgcggcattgccgcccatcaccatcagtcctttcagggctggctttttctcttgatgtagactcggtcataaggagtatgccgtgcagacgttcactggtcgttgtctttgcggacaaagccattttaccgttgacgtcgaaatgctggatgtctatgcctgccattgtacgctgtgtcaaaaatggtcgggtggaatagccatgtatctggaagcctgcgggcaaccacagctagcccccctttccccggaaccgccatacttttcatcctcttcgcgcggcgaacgctacttctgttctggctgcgggtgtccgctgtggtttcggcttaccgataccgatcgctatttttccctggaccttactggaactgaacgaagttgatcgccgtcggctgattctggctgcggaaatttataccgaaacccagcctgccttctggcgactgacggggcaatacgcacgcctcagcggtaaagaggttgaggaaatagactccccctgccagctagcgcattaagcgcttatctcatcaggcgttatgttatcggcgttgggcttttgccaggctgaaccacatccctaccgccagcaaaagaagcatactcccggcgctgcttaacgccacgctatgcgaccagataaaggcgtgtctggcggcgtccagtattgcctgcccctgcgtgggcggcaggctattcgccaactgcacggcttctcccattgaagatgacgctctggcaatctcttgcgcctcaagcccggcaggcagacggatagacgcggagaagctacggcttaacaacaggccgaaaatggcgatgcccagtcccgcgcccagttcataagccatcgtttctatcgcgccggccgccgccgctttttctgccggcacagcggccataattgccgacgtggaagccagcaatgcgctggcggtgctaaatcccagcagcgccatcagcccccaggcctgccattgttgggtgctgaaatccgtcatcgccagaccataaaaactcagcgcgcttaacgccatgccgcccgtcgcgaccagccgtaaccccagacgcgagaccagcgcgcccgcaatcggcccgctgaatccactggcgaccatcaccggcagcataaataccccggcctcataaggcgatagcccgtgaacaaactgtagctcttgcgccatcagcagctcaaaacccaccagagtgatcatcgcggtcatcgccatcacgacgccgctcaggataatgcgatgggtaaatagtcgcatatcaatcatcggacgcgatgtcgcaagctgtgtgcggataaagagtcccagtagcaacgcgccggtaagcagggtaagcgagatgacccacagcgacaaattccctttcagcgcggttttagcgctatagaccaacagcaaaatggcaataatcagcatcaccgcatggccaagattgagcggttgatcgcgacggcccgcctgacgaggaacatagcgggcggttaagcccatgacgaccagcacaatcggcacgttgatcaggaaaaccgatccccagtaaaaatgctctaataatatgccgccgatgagcggcccaaacgccgctccgcccgaacctaccgcagcccagacgcccagcgccatgttgcgatgcttctcttcacaaaaggtggcgcgtatcccggccagcgtcgccgatacaatcatcgccgcgccaatagccagtaataccctggtggcgataagccaactggcggtatgcgaaaacgccgccgccagtgatgccaggccaaagagcgtcccgcccagcatcagcaggcgtttaaaaccgatacgatcgccaagcgcgcccatcggcaacaccatgccagccatgaccaaagaataaatatcaatgatccacagcagctcgttgccgctggcccccagtgtcatactcagtgtcggcgcggcgacatgcaagaccgtggcatcaatggcgacaggaatatagaccagcacaataatgactaacgttaaccactgacgaaacataactctcccttcaaaaacttaaacctggacacctgtccaatttcaggatcctacggtaagttgaacgaatgtccagctttttgttacactgcgcgcattggctaatgtggggaaaatatgagttaccttaaccgggatgaacgccgcgaagtgatcctgcaagcggcgatgcgcgtggcgctggcagaggggtttgccgccatgacggtgcgacggatcgcatcagaagccgatgtcgccgccggccaggtgcatcaccacttcagctcggcgggcgagctcaaagcgctggcctttgtccatttgatccgtaccctgctcgatgccgggcaagttccgccgcccgccacctggcgtgcacggcttcacgctatgttgggtagcgaagacggcggctttgagccttacataaaattgtggcgagaggcgcaaattctggccgaccgggacccgcacatcagagatgcttatctcctcacgatgcagatgtggcatgaggaaacggtcacaattatcgagcagggcaaacaggcaggagaatttacgtttactgctaacgccacggatatcgcctggcggcttatcgcactggtgtgcgggctggacggtatgtatgtgctgggtattccggaaatggccgatcccgcgtttaaataccatctggatcgtatgattacgcttgaactctttgcgtaaagttacaaataatttaataaaaatcgcttttaatttacaaatagtaacaattaagaaacatcatatctcctcttcgcgccgcgctggcctggttttttatctattctttcactcaatattctaaaaaaacttcaataagttctcaaaagagcgcgtgacgctctgtctcttttttgtgttttttttcaaatgatatgcgcatgtgaggggtaaaatgacacgacaaaacgagaattataaccgttatctcttgagtgactggcgacccgaaaatccagccttctgggagaataaagggaaaggcatcgccagaagaaacttatggatttcagtaagttgtttgctccttgcattttgcgtctggatgttgtttagcgctgttgccgtcaacctcaataaaattggatttgattttacgaccgaccaactctttttattaaccgcattaccttctctttccggcgcaatattacgcgttccctactcctttatggtaccactgtttggtggtcgtaaatggaccgtattaagtaccgtaatattgattattccttgcgcctggctgggattcgccgtgcaaaatcctgccacccctttcggggtatttatactcatcgctctgttgtgcggttttgcgggggcaaatttcgcgtccagtatgggcaacatcagttttttctttccaaaagccagacaaggtagcgcgttgggtattaacgacggactgggaaatcttggcgtcagtgtgatgcagttgattgcgccgctggttatttttttgccgatatttacttttttaggcgtccggggcgtgccgcaacctgatggctccctgctcgccctcactaacgccgcctggatctgggtgccgttactggctgttgcgacgcttgccgcctggtttggtatgaacgatatcggcagttcaaaagcgtctgtcgcctcgcaattgccggtgctaaaacgtctgcacctgtggctgcttagcctgctgtacctggcgacattcgggtcattcatcggcttttccgcaggtttcgccatgctcgccaaaacgcaatttcccgacgtaaacattctgcaactggcgttctttggcccctttatcggcgcgctggcgcgatcggcaggcggcgtgatctccgataaattcggcggcgttcgcgtcacgctcattaattttatctttatggcgctgtttaccgccctgctattcctcacgctgccaggctccggcgcaggcagctttagcgcgttctatcttgtttttatgggcctgtttttgacagcgggtctcggcagcggttctaccttccagatgattgcggtgatcttccggcagatcacgctctacaacgtcaaactgcgcggcgggagcgatgagcaggcgcagcgcgaagcggtgacggataccgccgccgcgctcggttttatctccgctattggcgctgtgggcggcttctttattccaaaagcgtttggcacctctttggccttgaccggctcgccggtgggcgccatgaaaatctttttgctgttttacatcgcttgcgtcctgctgacctggctggtctacgggcgtcttaagcctaaacaacaataacaacatacgcacttgtaggacggccatccggtaatggtttaacgccaaatcgacaggatggcggaaaatttatcgaagcaggagaaatgtcatgagtaaactgttggatcgctttcgttactttaaacaaaaaggcgatacctttgctgacggccatggtcagatgatgcataccaaccgcgactgggaagacagttatcgccagcgctggcagtttgataagatcgtgcgctcaacccacggcgtcaactgcacgggctcctgtagttggaaaatttatgtcaaaaatggtctggtgacgtgggaaacccagcaaaccgactacccgcgcacacgtcccgatttaccgaaccatgaaccgcgcggcgccagctactcctggtatctctatagcgccaatcgtttgaaataccctctggtgcgtaagcggctgatagaactgtggcgagaggccctttcccgccacagcgatccggtgctggcatgggaatctataatgaacgacccgcaaaaatgccaaagttacaaacaggtgcgcggacatggcggctttattcgttcgaactggaaagagctgaatcagctcattgccgccgctaacgtctggacaatcaaaacctatggcccggatcgtgtggcgggtttttcacctattccggcgatgtcgatggtttcttacgccgccggaacacgttatctgtcattgcttggcggtacttgtctgagcttctatgactggtattgcgatcttccgcccgcgtcgccaatgacctggggcgagcagactgacgtgccggagtccgccgactggtataactcagcctacattattgcctggggctctaacgtgccgcaaacgcgtaccccggacgcccacttctttaccgaagtgcgctacaaaggcaccaagacaattgccatcaccccggactattccgaagtcgctaaactgtgcgatcagtggctggcgccaaagcaaggtaccgacagcgcgctggcgatggccatgggtcacgtcattttgaaagagtttcatctcgataatcccagcgactatttccttaactattgccgccgttataccgacatgccgatgttagtcctgttggatgagcgcgcagacggcagttatgtaccggggcgtatgatgcgcgcgtcggatctggtggatggactgggagaagccaataatccggaatggaaaaccgtcgcgctcaacagtacgggcgaactggtcgcgcccaacggttctatcggttttcgctggggcgaaaagggaaaatggaacctggaaccggtggcggcgggcgtcgaaactgaactgtcgctctctttactcggtcagcatgatgacgtggcgggtgtcgccttcccctattttggcgacaacgaaaacccacattttcgcagcgtgcggcaggaaccggtgctggtacgtcagttaccggtgaaacgcctggctctggcggacggtagcgagcggatggtcgtcagcgtttacgatctggtgctggctaattatgggctggatcgtggtctggatgacggccatagcgccaataattataacgatgtcaaagcctacacgccggcctggggcgaacagattaccggcgtgccgcgtcgacatatcgaaactattgcgcgtgaatttgccgagaccgcccataaaactcacggtcgttcgatgatcatcctcggcgcgggagtgaatcactggtatcacatggatatgaattaccgtgggatgattaacatgctggtgttctgcggctgtgttggacaaaccggtggcggctgggcgcactatgtcggccaggagaagctgcggccgcaaaccggctggctgccgctggccttcgcgctggactggaatcgcccgccgcgtcagatgaacagtacctcgtttttctacaaccatgccagccagtggcgctatgaaaaactgactgcgcaagagttgctgtcgccgttggccgatccgactaaatttaccggacatctgatcgatttcaacgtgcgcgcggaacgtatgggctggctaccctcggcgccgcagcttaatcttaacccgctcagcgtgaaagcgagcgccgataaagccgggctgtctgcggcggattataccatgcaggtgttgaaatcaggcgctatccgttttgcctgcgaacggcctgacagtggtcataatcacccgcgaaatttatttgtctggcgctctaacctgctcggctcctccgggaaaggtcatgagtacatgctcaaatatctgctgggcaccgacagcggtatccagggcgaagcgctgggttccagcgaaggaattaagcctgaagaggtggaatggcagtccgccgcgattgagggcaagctcgatctgttggtcacgcttgatttccgtatgtccagtacctgtctgttttccgatatcgtcttgccgaccgccacctggtatgaaaaagacgatatgaatacctcggatatgcatccgtttatccaccccctttccgccgcggtcgatcctgcctgggaatccaaaagcgactgggagatctacaaaggcatcgccagcgccttttctgaagtgtgtgtcggacacctcggacaggaaaccgatgtggtgttacacccgctccagcatgattccccggcggaactggcgcagccatttgatattctcgactggcgtaaaggcgagtgcgaacttattccgggcaaaaccgcccccaatatcgtcgtggttgaacgcgattatccggccacctatgaacgttttacctcgctgggtcccctgctggataaattaggcaacggcggtaagggtattgcctggaatacgcaagatgaagtcgatttcctcggtaagctcaattacaccaaacacgatggcccggcgaaaggacgtccgcgcatcgacaccgcgctggatgcctcggaagtgattcttgccttagcgccggaaactaacggccaggtggcggtgaaagcctggcaggcgttgggcgagatgaccgggcgcgagcacacccatctggccatcaataaagaagatgagaaaattcgctttcgtgatatccaggcgcaaccgcgcaaaattatctccagcccgacctggtcaggactggaaagcgagcatgtctcttataacgccgggtataccaacgtacatgaactgatcccgtggcgcacgttgtcggggcggcaacaactctatcaggatcatgcgtggatgcgcgcttttggcgaaagcctggtggcatatcgcccgccgattgatacccgcagcgtcagcgaaatgcgagaaattccgcccaacggtttcccggaaaaagcgcttaacttcctgacgccgcaccagaaatggggaattcactccacctacagcgaaaacctgctgatgctgaccttgtcgcgcggcgggccgattgtctggatcagcgaagccgatgcccgtgaactgggtattgaagataacgactggattgaagccttcaacgctaatggcgcccttaccgctcgcgcggtggtcagccagcgcgtcccgccgggtatgaccatgatgtaccacgcccaggagcggattatgaacattccgggttcggaagtcaccgggatgcgcggcgggatccataactccgtgacccgggtctgtccaaaaccgacgcatatgatcggcggctatgcgcaactggcttacggcttcaactattacggaaccgtgggttcgaatcgcgatgaattcatcatgatcaggaagatgaaaaacattaactggctggatgatgagggccgggatcaggtacaggaggcgaaaaaatgaaaatacgctcacaggttgggatggtactgaatctcgataaatgtattggctgtcacacctgctccgtcacctgtaaaaacgtctggaccggacgtgaagggatggaatacgcatggttcaataacgtcgaaactaaaccgggtattggctatcccaaaaattgggaagaccagcaggagtggcaaggcggttgggttcgtgatgttaatggcaagataaggccccgtctgggcggcaaaatgggggtaattagcaaaattttcgccaacccggtgattccgcaaatcgatgattactatgaaccctttaccttcgattatcagcatttacatacagcgccggagagtaagcatcagcccactgcccgtccgcgttcactgatcgacggaaaacggatggacaaggtgatctgggggccaaactgggaagagctgctcggcggcgagtttgaaaaacgcgcccgcgaccgcaacttcgacaacatacaaaaggagatgtacggtcagttcgaaaacaccttcatgatgtacctgccgcgcctgtgcgaacactgcctgaaccccagttgtgttgccacctgcccaagtggcgctatttataagcgtgaagaagacggcatcgtgctaatcgaccaggataaatgccggggctggcgtttgtgtatcagcggctgcccatacaaaaaaatctactttaactggaagagcggcaagtctgagaaatgcatattttgctatccgcgtattgaatccggccagccgaccgtttgctcggaaacctgcgtcgggcgcatccgttatcttggcgttctgctctacgacgccgacaggattgaagaagcggccagtaccgaacacgagacagatttgtatgaacgtcagtgcgatgtgtttctcaatccgcacgatccggcggtcatcgaagaggcgcttaaacagggcatcccgcaaaacgtcatcgacgccgcccaacggtcgccggtgtacaaaatggcgatggactggaagctggcgcttccgctgcacccggaataccgtaccctgccgatggtctggtacgtaccgccgctatcgcccatccagtcatacgccgacgcgggcgggttgccgcacaatggcaatattctgccggcggtggagacgctgcgtattccggtccagtacctggccaatatgctcagcgcgggcgataccggcccggtcattcgggcgctaaagcggatgatggcgatgcgccactacatgcgctcgcagacggttgaaggcgtgacggatacccgcgccattgacgaagtcggtctgagcgtacaacaggttgaagagatgtatcgctacctggcgattgccaattatgaagatcgttttgtcattcccaccagccaccgggaaatggcgcgcgatgcctttccggagcgcaacggctgcggctttacttttggcgacggttgtcacggctcggataccaaattcaacctgttcaacagtagccgtattgatgccatcaatatcaccgaagtacgtgataaagcggagggggaataatgcaaatcctcaaagcgattggcctgttgatggagtatccggacgacgagttgtgggaatgtcgggatgaagcgcttgccctaatccaacacgatgcgccaatgctggccaacttcactcgcgagctgctttatgcgccgttactggataaacaagcagaatggtgcgaagtgtttgaccgcgggcgcgccacttcattgctgttattcgagcatgttcatgcggagtcccgcgatcgcggccaggcgatggtcgatttgttaagccagtatgaaaccgtgggcctgcacctcaactgccgcgaactgccggatcacctgccgctctatctggagtacttaagcgtgttgccggaagcggaagcgcgcgagggattacagaatattgcccctattctggcgctactgggcggtcgtctgaaacagcgaggagcgccgtggtatcaactatttgacgccctgctgacgctggcgggcagtacgcttacaagtgacagtgtcaccaagcagattgttcaggaatcgcgggatttttcctgctcttcccgttcacccgtctggttcatgtctggagcgcgccgttcgagtatttcacccgtcgctaccagattgttcgtacccgccgctaattctctttgaccgggggtacgcttaccgggcaaagaaaaacgcctgggcgtcgtcattcggcaacgcacaggctatgatgattcttcagtcaaaggagaacatcaatgaaaccgcagatttaccatgttgacgccttcaccagcgaaccctttcgcggcaactctgctggcgttgtcttacatgcggatacgctaagcgacgcgcagatgcagctgattgcccgtgaacttcgtcactcggaaaccgcctttttgctaaaaagcgaagagagtgatgtgcgcatacgctactttacaccgacagtagaagtccccatctgtggtcatgccactgtggccgcgcattatgttcgggcaacggtactggggttgggaaacaccaccgtctggcaaacctcgttagcgggccgtcatcgcgttgaaattcatgccgaacacaacgactatcgcatcacgctggaacaaggtcagccctcttttgaaccaccgctagtcggagagattcgggctgccatcatcaccgcactgaacctgactgaagatgatatcgtgccgggagcgccaattcaggtggcttcaacaggacatgcaaaagtgatgatcctgctcaaaccagacgttgatattgatgccctttcgccgaatctggcagccctgacggcaatcagccagcaaattggctgtaacggcttttttcctttccagattcgtccgggaaaaaacgaaaccgatgggcgaatgttttccccggcgataggaattgtggaagatccggtaacgggaaacgccaatggcccgatgggggcatggctcgtccatcatggcctgatggcgcatgacggtaaaacgctacagattcaaggccatcaggggcgcgctttaggcaaagagggtactgttgatgttaccgtcaccattcgcgataaccagccggaaaacgtcaccatctccggccaggcggtcattctgtttcatgccgaatgggccattactttttaatctttgtcaggcccgcaaatcctcgcggcaaaaaattattttcccgcctccggatgggtatcaaatgcagccattaccgcggccagctccgcctcggtaaaaccgtgctttacatcatttacgccgagaccaaactgctgctgaagtaactgatacaacgacggtacatccggtatattgacctgttcaacggcatgtccctggtggtaacgcgtgaagtggaaattcgttaatgtcagcttgccgccatcaggcaaatggcggcacatcaacaaatgatgacgaaaatgggattgcggccagtgagccgaccagaaattgcccattacatgatcgctctgctgctgcacccccagatcaaaacagtacatcgactgccagtgctcatggtggcggaattgtaaaatccatgtgctcccctcctgtatcaggcggtattcgccatgcggcgtttgctgggcaatttcagcctgcagacgaagcggtgcggttagcgtttggccgccaaaccccacgtccgcgatccactgctcatcctcaacatcaaccagcagcaaacggtgcgtgcgcggcggtaaactggcgggatgagacagaatgacccgccccaataagcttcggacgttaaaaccgatgtcgcgtaacgcgcgttcaaacaggccattcagttcaaaacagtatccaccgcgtcgggcataaagcagtttctcctctagtgccgtctcatcaagctgtatttcacgaggcagtagcacatccagattttcaaaaggaatcgcgcagttgtgcgctaagtgaagcgttctgagcgcttcaaccgtaggaccccccaacggctgacaatttaatcgcgtaaaataagcatgtaaaaaagaggtcatctgaggcttccattaacattaatgcttgcgttcggcacacaggctgaggtggatatcgctgcgcaacaggataccctatccgtggaatagcgttggatacttttgaaaaaataagacaggccggctacagccgccggggtacgtagaattttggcgtataaacggaaatcgggttctgagaatctctttgcgacacgccgccaaaatagcggcgtgttaaaatttttaacgccagctcagcgagtctgatttctaacaaaactggctaaacataaacgctttttaatacttgtctaaatagttatggtaacgatcttttatgtcggccgcccgttgcgctttcgcctccggcatgtcgttggcccgatcggtataatattttaaactcggaatggcgcctaatgcctgaggtaaggcattatatgctgctattcgctctctgacggttttatatttttcatcaatatcataaccatagtatgctggcgcttcaaaaaagccctcttccagtctcatacagatatcttcaaaggaccccttaacctcaacgctatgttcgccatccgatatcctgacgattggctcacgtccagccatcagcgagagttgttcgaatgttaacatccgaccatcagaaagctcgacatctataataaattgttcatcacgtacagcatctgcaaggtgattatggatattccctgcattggcacagaactcatcaactttaggcgtaacattgcaataatgttcaattactcgcgtaaatccgtaggccagtcctgcggtaagcacatacaagatgcctttcatgatttttgttgataatttattttcataatctcctgcagcaacatgaggtagcttatttcctgataaagctctggcataggtagaaactgatgtatatggcatatcctgctccttcaaattttgctcaatagctttatatgtcctactcctctctcattatgacgatatgtcaatcaacaaaattgctcaaaggcatacattttcaggagaaaatgagaataacaggcgcaacggcctgatcttatgctgcttcaatatcgtcaggtggtttatcgttcgaggtcatatctatgaccataaatccctgcagggattaactctgattaattattgcgcaacgcaatcactgcggatttgtgctgaaagcttatctggctgaatcgtgaccacaccgcaccacatctgaccgcacaaataaacacgacatcctcattttgttctttccgtatgttttgcgtcatttaacaattgcaggtaggatgctccgccggcggttttatccctgtcacagaatcagggaaaagcggcattcgccattgcaggcaatcgattggtgagcgcccgtcgcggcataaggaatttttctgtcaggacaggctataacaggtaacgtaatgaaaacacagactacgcacgccgcagaacaacatgcggcgaaacgacgctggctgaacgcccatgaagaggggtatcacaaagcgatggggaatcgtcaggttcagatgattgctatcggcggcgcgattggcaccggtttatttttaggtgcaggcgcccgattgcaaatggccggaccggcactggcgctggtctatctgatatgcggcattttttcttttttcattttacgcgcgctgggcgaactggtattgcatcgcccttccagcgggagcttcgtctcctacgcccgtgaatttttgggtgaaaaagcggcctacgtagcaggctggatgtactttattaactgggcgatgaccgggatcgtcgatatcaccgcagtggcgttatacatgcactactggggcgcatttggcgacgttccgcaatgggtgtttgcgctcggcgcgttaaccattgtcggtaccatgaacatgatcggcgtaaaatggtttgccgaaatggagttctggttcgcgctgataaaagtactcgccattgttatcttcctggtggtaggcacgatttttctcggtaccggtcaaccgcttgagggtaatgccaccggttttcacctgattacagataatggcggctttttcccgcacggcctgttgcccgcgctggtactgattcagggcgtggtgttcgcttttgcttcgattgaattggtcggtaccgccgctggggagtgcaaagatccacagacgatggtgccaaaagccatcaatagcgtgatctggcgtattggtcttttctatgtaggatcggtcgtattgctggttttgctgctgccgtggaacgcctaccaggcggggcaaagtccgtttgtcaccttcttttctaaacttggcgtgccttatatcggcagtattatgaatatcgtggtgttaaccgccgcgctttccagcctgaactccgggctttactgtacggggagaattttacgttcaatgtcgatgggggggtccgcgccgaaattcatggcgaaaatgagccgtcagcatgtgccctatgcgggtattctggcgactctggtggtttacgtggtcggcgtgttccttaattatctggtcccctcccgcgtgtttgagatcgttcttaattttgcctcgctcggcattatcgcgtcgtgggcgtttatcatggtgtgccagatgcgtttacgccaggcgataaaagaaggcaaagccgcagacgtcagttttaaactgcccggcgcgcctttcacctcctggttaacgctgctgtttttattaagcgtgctggtactcatggcgtttgactacccgaatggaacttacactatcgcctcgttgccgctgatcgctattctgctggtcgccggctggtttggcgtgcgacgtcgcgtggcggagatccatcgcactgcgccagtgacggcggattcgacagagagtgtcgtattgaaagaagaagcagcgacataacattacccttccccggcagcctcaggcctgccgggtttaatgcgcgttgccgccaacaccgcatcgcgcccaatgcttagtcagccttaatcaactgcgccacatcattgctgttaatttcccgctggttgccttcctgatcggtataactggtcattcccgtctctttatctaactgcggcttaccctgagttacgatcgtttgcccattcttcgtcgtcatcacatagttggttgtacaacccgcaagcataaaaaacatcatgcccaaacctgagcatataaataactttttcatattttcctcgtgaatataatgagttaacgactgcaaaaaggtagtgtaattctcacagaatcatcaggctatcggcggggtttaacgaggcgtatcggtgcgtttaaagagatgactggaggggtttccccctccataccctatttacagagcaatgcgaataacatcatccggctgcgtcgcttcttgttcacgtgtcgatttctgcttcacgctgacgtagagcgttttaccgtctgccgatagcgccaggctattcgggtacgtcggcgtatcgaacgttttaacaacgttataggtcttcgcatcgatcacgctgacctgccctgcctgacggtgcgtcacatacgcctcgttacgtgtcggattatacaggacggccaaagaggcaggcgccgcgattttggcaagaatattgccattacgggtatcgacaaccagaacctcagttgccttcgagtcggtgataaacgcgcgatgacctgcggtatcgagactcagattaataaagaagtgttctttaccgtcatccagcaacttcttacgactgagaattttattgctggcggtatcgatggtgataaattcgccatccgcattggtggtgtacaggcgttgtgctttactgtcgagcgccagacccgtactcattttgccggtattttcgatcgtcgttttcagtttgatggtttcgccatccactacccaaatagcactctctttaccaacaccgctaatgtagatcgtgttggtcgccgcatcggcaaccagctcacggggctgtaacggacgaacctcttcagtacgtttgcgcgcatcaagtaccagacgaccttttacatcacccgttttggcatcaatcgcggtaactgcgctgttaatggtattgccaaaccacagcgtttgggtcgcggcattgatggtggcgccgaacggcttgagatcgttatgaatcgcttgcgtgatttccagcgtcaccgggtcgagacgataaactacgccgcctttatccagtttacggctttgcgatgtagccagccagagcgcgttttcttgctgactccaggccatctcataagcgcctttgcctaccgctttacgcagcatgtcttccgccgccagcgtgctaaatgaggatgcgacgaggagcgaacctaacaataaagaaccacgcaggcgcggcgaaaaaagatgacgtaagtgcatgacgactccttttgataaaaacgtgtatagctgcttcacactacttcgctgcgcgggatcttcgttccgcacttattataagttgagaataataatcattatttatcagaaagtggagcttttcctcgcctgcgaatgtcatggctcttaaataccgcacattttcttaacttaatgtgcgattaaaatttcaaaactttacatattgactacccttaatgtcacgttttccgttgatacgcttacatttatccggcattttcatgaaaattatttccgttagacagcgactttatcccgccctcttattgcctctgaccttctccccggtccttcaggccgccagcgcgcccaatgaacaaaccatgatagtcaccgcaacgccgcaaaccgtatccgagctggatacacctgccgccgttagcgtcattgagggagaagacatgcgtctggcgacgccgcgcgttaatttatctgagtctttaaccagcgtcccgggattgcaggtgcagaaccggcagaactacgcgcaggatctgcaaatctctatccgtggatttggctcgcgttccgcctttggcgtgcgcggcattcgtctgtatgttgatggcattcccgccaccatgccggatggacaaggccagatttcaaatattgatattaacagcatacaaaacgttgaagtgttacgcggccccttctcagcgctatacggcaatgcttccggcggcgtgataaatgtcaccaccgaaaccgggagacagccgcccacccttgaggccagcagctactacggcagttatggaagctggcgctatgggttaaaagccacgggcgcgatgggggacggcacacagcctggcgacgtggattacacggtatcgactacccgtttcaccacccacggctaccgcgatcacagcggcgcgcgaaaaaatctggctaatgccaaactgggcgtgcgccttgacgatgtcagtaaactttcgctgatttttaatagtgtggacattaaggcggacgatcccggcggacttaccgaatctgaatggaaagccgatccgcagcaggcgccgcgcgctgaacagtacaatacgcgtaaaaccatcaaacaaactcaggcaggattgcgttatgaacgtcagctcagcgcgcaggatgatatcagcgtgatggcctacgccggagagcgggaaaccacgcaataccagtctattcccctggtggcacagctaaaaccagcccaggctggcggcgtaattacactgcaacgccactatcagggaattgattcccgctggactcaccggggagaattaggtgtgccggtcaccttcactggcgggttaaactatgaaaacatgagcgaaaaccgcaagggttacaataatttccgtctcaacaacggcacccctgagttcgggcataaaggcgatttacggcgggatgagcgtaacctgatgtggaatgtcgatccttatctgcaaacccagtggcagcttacgcaaaaactctcgctggatgctggcgtgcgctacagttccgtgtggttcgattctaacgatcactatatcgcgcccggcaatggcgatgacagcggcgacgccagctatcaccactggctacccgccggatcgctaaaatatgcgttaactgacgcctggaatctctatcttgctgccggtcgcggatttgaaactcccactatcaatgaactttcttatcgcgctgacggccaaagcgggttcaactttgacctcaaaccgtcgaccaatgatacggtggaagtcggcagtaaaacgcggattggcaatggcttgttgaccgccgcgttatttcaaaccgataccgatgatgaaattgtcgtcgccagtagtatgggaggacgcactacctacaaaaacgcgggcaaaacgcgccgccagggcgcagagctcgcgttggaccagcgcttcgccggcgactggcgggtgaaagcatcatggacctggctggatgcgacctatcgcagtaacgtttgtcaggggcaaaactgtgatggaaaccggatgcccggcatcgcccgtaatatgggattcgcctcattaggttttatcccggatgaggggtggtacgccggaacagacgttcggtatatgggcgatatcatggccaatgatgaaaataccgccaaagcgccttcgtataccgttgttggactaaatacagggtataaatttaattacagtcagcttaccgtcgatatttttgggcgggtagataatctatttgatgaagaatatatcggttcggtgatcgttaatgaatctaatggccgatattatgagccagcgccagggcgtaactatggcgtggggattaatctggcatggcaatttgaataaatatccggcaatagcggggcatccccgctattgattagtcatagtttcatgaaagttacatgaagtactgatttttaatcgtcgctacgttttgttgcaaaacgttctgtaggcagtggcgactggcttctttatcaccagtcactaacgcattaagcaattttctgtacagattaacgccgttttgataatcatcaagtttaaaattatcatataaaaaatgcagacttggccccaggcgtacccataattgctcgatcatggcatacagcgttggcatatccgcgtagtggtagatctcaaagcggaatgcgcggttggccaaaagaattttctccataacgccactttccagcgcctgttgaaattcatctaatagcgcattcagcgtctgctcgcgatccggggtaatcttacccgcagcggcgaccaccgccatctcctccagggcagtacgaatcgtattaatttccagcaaactttccagcgagatctccggcaccataaacgcctgtgctggcgccaccgccaaagcactggaagagaccagccttaacagggcctcacgcaccggcgtaatactgacgcctaactcttgagcgatatttttagtgataagccttgcgcctggttttaatgcgccaatagacaattgatgctttaaccgattttcaacctgtgtggtcaggcttatatgttgtgttttttccgtacccggcattttccttccttcacctcttggcagaacaacatcgcaatcgagtcccgaagaagtttcggaacttaattgtaaaaaagataatccagacctgaacggccaaataaataaaagtgataatttacttgcgtgatattctcatcttttacaacaatacaggtttctttatggcaaccgttttatctccgtcattccttcatgtatcgagatttttgaccggttcaggccgctgagggagataagctgccccaccgcgatctgaatgatgaatataagtaaagccgcaattttaaaatttgcacatttttatggcgacataatgccgccattttttctttacgcatcgtccgctaaacgtatcacgactttgccaaagttcttccccgccagcagccctataaacgcttctggcgcattttccagcccatcagtaatctgctcccggtaatgtattttcccttctttgatccaacgccccatttcttgctgaaactcatgtatccggtgaccatagtcctggttgatgataaaaccttgcaggcgaatacgctttttaagtaatgtcgccatcagcagtggcagtctgtctggaccgtccggcaacgttgtcgcattgtagccgctgaccagaccgcagagcggaatccgcgccgacgtattcagtagcggtaagacggcgtcaaagactttaccaccgacattctcataatagatatcgataccctgcgggcaggcctgcgcaagctgttgtgggaaattatcagcgtgatgatcaaggcacagatcaaatcccaaaacgtctgtcgcatgacggcatttttccgcgccgccggcaatacccacgacccggcagcccttcagcttgccaatttgcccaaccgttgcgcctacggggccggtggcggcggcgacaaccagcgtttcgccctctttcggctggccgatatccagtaaccccatataggcggtaaaccccggcatccctaaaactcccaacgaccaggaaggatgttgcggattatcacccagctttaccaacccttcgccatctgaaatgtcataatcctgccaaccattgtaactcaacacccattcgtctggtcggtaatcaggatgattcgacgcgacaacgcgactgaccgtaccgccaaccataacgcagccaggttcaactggcggcgcataagagggttcatcgctcatgcggccacgcatataagggtcgagtgataaaaaaacggtacgcaatagcacctgcccttcaccgggcgtcgcgacgtcatcttcttcgaggcggaagttatccatctgcggcgcgccgtggggacgcgaggccaaaacccaacgacgatttcggttggtctgttgcttcattctattctcctcatgcctggcataatccatcaataatagtcgaacattagctttctgagggagttaaacactctcagatatcaggctgtgcgcttttatgaacgactttctttcccctctcgctaaatatgaattcttgcgctaattcgttgatttatgccgccttcaatagtatttctaacactatcgtaaacattccctggggttccctatgacgattcgctttgccgataaagcagactgcgccgcgattaccgaaatctataaccgtgcggtattacatactgcggccatctggaacgatcggacggtcgatacggataatcgccttgcctggtatgaggcccgtcaattactgggctatccggtgctggtaagcgaagaaaatggcgtggtgactggctatgcatcatttggcgattggcgcagtttcgacggttttcgctataccgtcgagcactcggtttatgttcatccggcgcaccaggggaaaggactggggcgaaaactgctcagcagactgatcgacgaagcccgacgctgcggcaagcatgtgatggtggccggtattgagtcacagaatgccgcctcgatacgcctgcatcattcgctgggatttaccgtcaccgcgcaaatgccgcaggtcggcgtaaaatttggccgttggttagatcttacgtttatgcagctccagcttgatgaacacgccgcgccggacgcctgctgatgaaccagtcgctgacgcttatctttttgatcgccgccggcgtcgggctggtggtacaaaacagtattatggtgcgtattacgcagacatcatcgacgattctgatcgctatgctgttgaactcgctggtagggatcgttttatttgtgacgatattgtggtttaagcaaggcgctacgggcttcggcgagctggtcgccagcgtgcgctggtggacattgatccccggtttgctggggtcattttttgtatttgccagcattagcgggtatcagaacgttggcgccgcgacgactatcgcggtactggtcgccagtcagttaatcggcggactggcgctggatattgcgcgtagccacggcgtcacgttacgcgcaatggtcgggccggcgtttggcgcgctgttgctggtcattggcgcatggctgattgcgaagcgccagttttaatgggttacaggatcgtgccgcctttggtgagctgttcgcggcgcgcgtcccgatcttcttgatattgcctgccgtgatgcgcgatagccgtgcgtaaacgctgctgctgcacataacgatcttcgtgacgtaattcagcgtcatcgctcaaggcaatcagcaattcattcatatgggcaattacgctctccgcgatggcggcatccacgcgggcgctcacttcctccaggtgcgacataagctctcctactctttattctgtaatagcatgattcgcctattatacgcgttattgtcgcccgatgcggtcattcgccgccgccactctgatttaacttacgtcaagtgaaaacacggggcttaatagaccgagaattcgcgcctttttgcctttcttccgccgtttgcttgcgtatagaccccgtaaagtagacgcgtgaagaagtctaagggataacaacgtggcaaaatctctcttgcgcagcggcaatctggatgattatcaggccgtgggcggcggcggtcaggccgtatttgaatcagcattgcaaattcgcgaaacgcttcgtctgcgtaaacagcagacgatggttgactgtctggcgattccgcaacttaacgataatggcgatcgggttgactggtattcgccgattgaaggtcaggcgatagcgtggaaagcggctgacgaagagacacgttctcgggctttacgttatttagccagcacttttgaaagcgcggctgcactcagtcgcaaaagtctgcaatccggtaaaacagcgctccagctatttggttcgctacttgagaaggcgacgcaatttcccggcgaaaatcatgttttcctggttaacggcaaaccggttatcaccttctggggattcgttaatctcaacgaaaatacacgcgatgatgtgctggactgcctgcgggtaaccgaggcgatctccgacatccctctggtcgagccggagccgcagcccgaagaaaagccgctggtagaggcggcgtttagtcaggcggatgaacctttgttaacgtctgtcattgagccgccgaaaatgccggaggaacctgctgcgccgcccgttatcgttagcgagccgaagcctgccgcacctatcccggttgctgaggcgaaaagagctcgccgtctaccgctgtggagcttacctgtcgctgccgtggttatcgccgccgtcgccacgccttttttctggccatcttcatccgttgacggggcctctcctgttcgcaccgcgcctgtcgctaccgcgaaaactgatgttaccccaatgcctgaactcaccgcgcatttgccgctgcatcgcgctgaggtgacgtccgcccccaaagcggcgccgctgccggaagcgcctgttatcattgccgctatccccaaagacgcgctggtgatggacaatacgcagatgaagcttggaaccacgcgctttttaaacggtagctggcgggtcagcgtggatgtcaaagatccgattaccggcaagccgccctctctgcgttatcagatccaaaataacaaaggcatcgcgcgcgtagtacatggcgataacgtggtttgtcgggcggaaattttctctggtctgcatcaaacgggcgagctgatgattaaaagtcgcggcaatgcgcgctgcaccgacggttcacgttatccgatgccggaaattacctgtaaagcaggcgtcaatgacgtcgcaacctgtaccgcccgttatggcgaccacgcggcaattccgttgacgtttaaaaagataggtgcctgattttatgttggtcaatctgtgtgattacaaacagagcgtcacgctcattgcaaacagtggcgtccagtttcttgattttggcttaacgccgcaagagtcggcccactacggacgttttgtgcgcaaaacggcaaacggcccgctactgcgcctcgattttgatctgaccagcgggcgctacacgttgccaggacgtgctggcggccaacccgaagtcgtgaaaccggaaagcactcagacgctgcactattctctggatgtactcgacgggatctggcttcccctgccgttcctgcgttttaatccgccgcgtacctttattgacgggccggataactgggcgcgcattcaggtacgtaaactcagcgagccagatagcgccggaaacacacaccgcatcaccctcgccttcgacagtcagctggcaaaaaatatgcctgcggcgttggcgccttgcgaaaacgatctgctcaatggcacacgttttgcgctcgcctggcgcgatgaagaagttgccgattttcttgaccagacatggattgacggctggctgcgcgagtcgtttcttcagtatgcctcacaggtggaaaaccgtccggaacaggccattcaacaagcgctgcgtagttttgagtatcaggcgcactggttgaatttactgacgctgttaggcgaacagcttacggtgccggaagtaaagtttgtgacacatacgttaagcacgcccgcaatcccggtcgatctgattctggatgtcggcaatacgcatacctgcggcgtcttgatcgaggatcatggcgatgcgaatgacggcttacgccagacggcagagcttcaggtgcgttctttaagcgagccgcagtatctgaacgatcctttatttaccagccgggtggaattctcagaagcgcgctttggcaagcaacacttttctgtcgaaagcggacgagacgacgcctttgtctggccttctattgtgcgtgtgggcgacgaggctcgcgcccttgctatgcagcgtgtgggcaccgaaggcagcagcggtatctccagcccgcgccgctacctgtgggatgaaacccccgccttgcaggactggcgctttagccagatccacggtaaaacgcagcgcgaaccgcttgccaccgcgtttccgctgatgaatctgatgaacgacgacggacagccgttattccgcctgccgcatgaagaaaggctaccggttttttcgccgcaatacagccgtagcaccttgatgacgcatatgttgtgcgaaattctggctcaggcgctggggcaaattaacagcgtcgccacccggctgcggctcggctttcccgcctcgccgcgccagctacgtaccctgattttaacgctgccttccgccatgccgaaacaggagcgagaaattttccgccagcgaatgtttgaagcgctggcgctggtctggaaagccatgggctggcatccgcaggatgaggatttcaccacgcctaagcagcgtgaaaaaagcgtggtgccagtacctgaaatacagatggaatgggacgaagcaagttgtggccaactggtatggctttataacgaagccatttcgcattacgccgggcgtaccgaatccttttttaatgcgctggccagaccggatcgccagcctgaacccggcgtcgtccccggacgcgcgttgcgcgtggcatcgattgatatcggcggcggcacgacggatatggcgatcgttcactatcagttagatgacggcgtgggggccaatgtaaaaattacgcctcatctcctgtttcgcgaaggttttaaagtcgccggggacgatctgctattggatatcattcagcgctgcgtactcccttccctgcaaacggcgttgcaacgggcaggcgttacggatgccgccgccctgctggcgaccttatttggcgattcgggacgaattgatactcaggccattttgcgccagcaaacggcgctgcaattatttatgccgctgggccacgcggtactttccgcctgggagcaaagcgacattaacgatccgtttgccggtttacatgcgacatttggcgatctgctgatccgccgcccaacgagcaacgtgatgaactatatccagcaggcgatcgatcatgccttaccgtctggttcgccgacatttgatatattcaatgtgccattgcaaatccagtttagccagcttcaggaggctctgctggccggtcagtttacgctgacaacgccgcttcatgcggtctgcgaagcgatctcccactatcactgcgatatcttgctggtgacggggagaccgacctgtttacctggcgtacaggcgctcatccggcacttacaaccggtgccggttaatcgcattgtgtggatggataagtatcaggtacatgaatggtatcccttcagtcaacaagggcgtatcggcaatccaaaatccactgccgcggtgggcgcgatgttatgcagcctggcgctggacttacgcctgccgcgtttcaattttaaagcggctgatatcggcgcgtattcgactgtgcgttatctcggcgtactggataataccgttaatacgcttcgcgatgaaaacatctggtatcacgagatcgatttggataaacccggcgcaacgctggacgcacgcctgcattttccgctacgcggcaacgtgacgttgggctttcgtcaacttgcgaacagtcgctggcctgcgaccccactctattgcctgagcattaattccgccgaactggcgaaaaccatcgctggcgacggcgtactgaatgtccgactgaaattacgcggcagtagcaaagatagcgccccggaatcgttcatattaagtgatgcctggctccaggacgggacgccggtcgccgccgatgcgctgacattaaaattgaatacgctggctgaccgccgccacagcggcagccactactggatagatagcgggagtgtatacctgaaatgacaaaaccgttaaacgccactcaggctgttatcgagtgggttaacaacacgcgccgttacgcaacgcgactggatgacgaagccgacgctctgctggcgcaacttacgcttgccgcggcggatgagtcagcgctcaacgccgcctgcgcatcatcacatggctgcgttggtctgtacgggtatgcgcaatccgcaaaagcgcatctgttaacgacgctatgcggtaacgagaatggcaagctggaaattatcacgccggaccgtgactatgattatttcagccacatcaatccgggtcatgcgccagcgaatatggctattcgctttacgcgcgacattttttcaaacgagagcggctggccgttgcgcctgcgcttgatcagtgaagccgaactggtgcagatctttattgcctggaccagctcgtcccccgtttgtcgccaggtcgaaaaatccattatcacatcacgcctggagaaatggcaatcgcttcgccaaccgcagcccgtccccggcgttaccgctgaagaggtagcgaccatcgcgagtttctggcgctcttgcctcccgtccgccagacaacatattgatgatgcgacatggcaacactttgcctcgctcttgcctgcgctggatctcacgacacgggcgcacgcctgggcattactgtggggagagcaaccagagatcacccagcaatggctggcgctggcgcatatgttgcaacaaaccggccatgccggggaactggcggcgccgctcagcctgctggtcgatcattttggcttaccggcggaaaacttcctgacgcaaatggcgctaaccgccagcgatacgcaaagcgatgtggtggtgcatccggttaaggaaggccgactgctcaatgcggtcagcctttcgcttgattctctggcgctgcttacccgcgaactggtgctaaccgttgaaaatagcgtactggataacgttgatttactggatattccggtcgcgccagacagtcatcctcatccgttatggcgggcgaaattaggctggatgctggcccattaccgtcagcagatacagcccgatgttctggtgatttgcaatgctctggcatctcgctcgcaaacgtccactgccgcccgtcacttactggagtgggttaacgccacgcagccgcagcatgaatcagcgttacccggcgtcgtctgggctattactccacaggatgcccgttttgccacccagcaaaatctggatgaagccgtccagcagttgatgggtaaacctggcgtgcattggggaacgttgcaggcgctggataaacacagtatgcagcgtttggtggagtggttatcgcaggcgacatcggcaccacagcgacaggcgcgcttacaggcgttacgcgaacaactgcgaggccgcgtgcgcgatctgttaccgatgtgtgatgacgcgcggctaccggttgaaaccgtgatccggcgtcttcaggcccaggccgccagacatggcgacctgctggccgggctgttaccgccggtacagaatttcgaagcgttgctgcgcacccgacagtcgcgagaagaacaggtcagcggtttatttaatgacgcgatcgatctctttgccgacgaaccaacgcacgcttcagcgtcagaaggtcatgaaacaggctaccaggcgcacaaaatgtggatcaatcatctgcgccagtgggcccactgccgggataatgcgcagcgtctgggactggaaccgcagatgctcaacgccgtggcggagattttaattaccgccagctatcgcctcggtttacctcagcagttacagaaaaccatgcagcgcgaggaggtgagcggcgcgcagcttcatgccatcattggtaacttcatcgcctggctcggctacgccaatatcgaggaggcccaacgcccggccagccgcgttcagaaaggcgcagccattttcgccgcaacgccgcgttcgacaatgttgcgtctaacaaagcttgacgaacagcccgttcacgccgccagccgctatgtctatgactggcttgttgcgctgtataccctggccaatgagaacgcaggatatcggcatccgcaggacgttaccgacgtagacagagcgcaattaattgccctgatagcctgacctggcggaaaaaccatgcccggtaacctgtatcgggcttgaggtcagaaaagcgaaaacagcaatgcgacggggaaacttatcggccatgtcgcgccaaccagaggaaaaaacgcgcgcaatatgctctttttatttgacacacatcaaggtttatcagccttaacagcaaaacgttctcaatgcacggctccgctcacagaatatcctgtttacgtattattgcggatctcgccaacccgtactatacccataggggttatgatgaaaggtggcgaaaatgaatgtttccagtaaaaccgtcgtgctgattaatgtctttgctgctgcaggacttttgggtctgatctcgttgagattcggctggtttgcttgaggtgttcaacctttgagtacttgctgcgcatgttggcggggaggtccccctctccgccgacacccgcctattttttcacgatttttctgaacagtaaatgatccttaatgcttaaccatgatgtggcggacaagggtgtagtcttccagaccatacaatgacatatctttgccgtatcccgactgtttttgccctccatgcggcatttcgctaaccaacatgaaatgggtattaatccaggtacagccatactgcaatctggcgctaagccggtgcgcccgcccgacgtcctgagtccagacggaggatgccagaccatagcgagaatcgttggcccacctcagaacctgatcttcatcatcaaagacggttatactgaccaccgggccgaagacctcgcgttgcacgatggcatcttcctgttttgcgtctgccagcaacgtcggagcgaaatagtaacctttaccttccgtttgacttccaccagtaatcacacggatatggctgagggccttcgcctcctctacagccgctgtgacgcgcttcaggtgcgccagcgaacttaacggccccagctctgtcgacttatcctccggcgcgcccattttcaggctgctcaccgcgttccctagcttttcgaccagcgcatcatagataccgcgctgcgcgtatatacggcacgccgcagtacaatcctgtccggcattatagaaaccgaaagtccggacaccctgcgccaccgcatccagatcggcgtcatcaaaaacaatcaccggggctttaccaccgagttccatatgcgtacgttttatcgctggcgcagtatggcgcagaatatgctccccggtcgcgatagaaccggttaaagagaccatgcgtactttttcatggccggtcaatacatcaccaacagtttgccctcgtccgaacaggacattgagcacccccggcggaaagatatccttcgccagcgcggcaagtttaagcgccgtcagcggcgtgatttcagaaggcttaatcaccacgcagttacctgccgccagcgctggcgccagcttccaggccgccatcatgagcggataattccacggcgcgatagaggcaaccacgccaatcggatcccggcggatcatcgacgtatgtccttccagatattcgcccgccgccagcccactcaaacaacgggccgcgccggcaaaaaagcgaaagacatccacgattgccggaatttcatcattaattacgcagtgcaaaggcttaccgcagttttgcgattcaagccgggcgaactcaagggcgttttgctcgatgctgtccgccagttttaacagacattccgcccgtgctttgggtgtggtctgcccccattcggcaaacgcgctatcggcggccagcactgcggcgtcaacctgcacgggcgacgcttccgcaatctcaagtatgacctcgcctgtcgccgggttataaacggactgcctttctccctcgccgtccaccagcacgccattaatcagtaattgatattgcatagcattttcccatatcgtcattaatcgatttccggcgaacgggccgccgctttcctaaaaatagacggcgcgccagatgctcacccggcacactcgggaaatttagtcaggttgtgagctgacacgcattccacctcacacaaggcttttagcgctcagcatctcgcgaatcaggcttccaagctgttttacggcctgttcttcccgttctccccaatgccatgcggtgttaaaacgaaagaaacgcgtccaggcgccggacgttgaaaacattttccctggcgcgatactgataaggtgttcaagcgctttggcgctaagttcgccggcatcaagctgctcaggtagctccagccaaagaaaataaccgctatcgttatggtgaatttttacttccgccgggagatggcgcaaaagggtttgccaggcttgctgtttacgttcggcaagctgccttcgcaatcggcgcagatgcgcgtcatatcgacgtgtcgagagataatctactaacgccaattgcatgggagaactggtggataatgtgctcattaactgcaaacgctgaatttgtctggcatggcttcctcccgcaacccagccaatgcgaaaaccgggaaccagacatttggaaaaagacgaacaatgcaacacggtatcgtcgcgatcccatgctttggcaggaagaggtttctcgcggccaaagtagagttcgctataaacatcgtcttcaattagcgtcacgttatggtgcgtgagtaacgcaaccagccgcgcttttttctcagcactcagcgtgaaccctaacggattctggctgttggtcattaaccagcacgctttcaccggatattcctgtaacgcctgttccagcgccataagatcgataccttctttaacatcggtaggtatcgacaacgctttcaggcgcaatcgctccagggcctgtagcgcaccgtagaaacaggggttctccaccaccacccagtctcccggtgccgtcaccgcctgtaaactaagattcaacgcttccagcgcgccggcggtaatgacaatctcgtcaggagaaacggtaatcccctgctgcgcgtaacggcgtgctatcgcatagcgcaattctgcattacctggcggcaagttttcgatgacgctcattgccgtctcggttttactgacctgcgccagagagcggttcaattgcggcaagggaaacagacgcggatcgggaaacgctgaggcaaagggcaccacagaggtatcacggctcgcctgcagcatctcaaaaatataggtattgatatctacggcttcatcccgaataacgtgcgctgccgtcgcgactgaccgacaaaccggatgcggcgcgacataataaccagattgcggacgggcgataatccgtccctgactttccagcaactggtacgcatgaccgacagtcataaaactcatgccgctactggcgacctgctccctcagcgagggtaatcgatcgccgggttgccaaacgccagaggcgatttgttctctaatttgctccgccagacgttgatattttttcattattcgttctcattgagcgctgcttgcaggtggcaaccgcagtgtatatcagttgttaaaattaacaatgatttgctaactgttatggtgctttccaacaggcgtaatgattagatttcgcaacaaaacgccgtttcagggtctctgcttaacgggaaagtcaaaccaggtgttcgggtatggttcatgagtaagggagaagtgccaccattcagtatccagtggcgtaaaacccgcatcacgcatcaatgtttgtaataacaacctatttgcgcgttgctgagcggtaagcatgacattatcgggatgggataacggactaaaacagtcaaagcctgtaccaaaatccagactattatctggcgagcgttgcgccgcggacgcagtacaattcaccagtggtcgtccgggatggtatatcggtattttactgtcaagtggaacaatcgttagatcaagcgtacttccccgactgtggccggatctggcggcaagataaccttcctcaaacaaacgatttttctctacctgcggataaaattcgtttttcatttggttttgagaaggatctttggcccacgcgataaagtcattcactgcgctttgcggacggtagcaatcatatatttttaaggtaagtccgaaggggcgtaaacgatcggcgacctgctttactgcgttcgcggctggtcgtgttaacaggcaaacaggcgcgttatagcctttaatggggcgaccaataaagttatgggaagtgaagtatcgcatgtctacctgtacgtcgggggcgaccgtagtaatatcgacaaagtcttttggctggtggagatcaatatggttttcagctgatattgcctgaacggacaacaggctgaacaggaggaaagaagatacgcattttaccatatgttacacctcgcgagagtcacaggggtgattatgtatttgagcaggtaaagattagcggacagcgcttaaacagatggttaaaataaacatcattccccccctgtaatctgtgccttattacaaacggagaggttatattttgcttattatggccattacgccgcctgttctatacccaaaataattcgagttgcttaaaggcggcaagggagtgagtccccaggagcacagataacgatatgttttcacaaaggcgagtctacctgaccagaaaggatatttgataatcaatagtacagttgttgtcgccttccataactaaataacattgtttcgccaaagataagaccactatatagtcaggaaggcaattagtgaggaacacgtcgattgtcggcgataatgcactgaaattacgattcactgcagttgtgcaaacacatagaatccccctcgaaccgagataattcggtctgctggtcatagccattattcagtaagaccgcaggttgcagcggcggatcacgggcgtgaagaaaaatcctgtgccccaaattttttggacaagcgctgaacctgccgtatacttttacttaacgtacactccgccataaaaataaaccctgcgatgataccgtaatgccacaggcataacttaaggatatgccataaatcaagcgaagcatgatttaacttctcagtaattgcgatagtctgtacaaatattatgggatgaaataataagacgcctaacaaaaatatccctgccacgatcatggcaagtaactggaaaaaagcccatccgataacgaaacggtaaagtaacagcaataatagccgtccacattttcttagccattctgactgcaaaatgccccaggatgctgtcttttcgtgaatttcaccatctgatttcttcattttgagcctcctcgcaggtttttataattttatcacctaactggaaataaacccgtcagctaatcgttacaacaaatataattaagacaaaaactaaagagtaaaggcatttatatcataagtactatcagcataggcctcctgccctgccgctaaatatctcattgttgttagcctaataatactttcagtttaacttcttataagacaatttgtacacggttgagcaacaatttactttctctaaaaataatatagcgtgtaattaaacattactcatggtatatgatgatgtgagaattaagaaaaccattttactttcattcgttttacctgacatacttcatggccaggaggcgtggactgactaaagccacgggtcgattttaacaataatgttgacggttcaggacaaagcaaaaatcaggtgtttcaccgataggcaaaccgatgggcaacatgggataatatttcgaataccacctattccagtaatgaagtatcatataatcacttgtggtctacattatgccaattactatcgggagaggatttttaaagagtgagatgttttctcaaagtgctatctctcaacgctccttctttacgtcactatgggaaaagattaaagattttttttgtgacacgcaaagatccactgccgatcaatatataaaggaattatgtgatgttgcctctccgcctgacgcgcaacgtttatttgatttattttgcgcgttatatgaattatcatcaccatcatgcagaggaaatttccattttcagcactataaagatgctgagtgtcagtatacaaatctctgtattaaagatggcgaagatattccgttatgtattatgatacgtcaggatcactactattatgagataatgaatagaacagtgctctgtgttgatactcagtctgcccacctgaaaagatattctgatattaatataaaagctagcacttatgtttgtgaaccgctatgttgcttgttccctgagcggttacaactctcgctatccggcggtataacattttccgttgacctaaaaaatatagaagagacgcttatcgccatggcagaaaaggggaatttatgtgactggaaggaacaggaaagaaaagccgccatctcctccaggattaatctgggcatcgcacaagcaggtgtaacagctattgacgatgctatcaaaaacaaaatagccgcaaaggttattgagaatactaacttaaagaatgcagcgtttgaaccaaattatgcacaaagctcagttactcaaattatttattcatgtttgtttaagaatgagatactaatgaatatgctggaagaaagttcctctcatggcctgctatgtttaaacgagcttactgaatatgtagcgctacaaattcataacagccttttttctgaagatttatcttcactcgttgaaacaacaaaaaatgaggctcattaccagagttgaccacaccataaatagtatggatttacaatcccctggcaataccaaaaccatctaatacaatacctttaaaaatatgcttccagggaataatggatttactatggaacgaattggctcgttatttttataattgacatactgagtataaatatattttctcatacaacttatcgcacttattgacaaaccgttttcgctaatttgaagtgttgaataataactcaaagaaattattggcatcatagcctcacgacgtaactggaaggtggcatgatgcttacaaaaacgttatcagtagttttactgacctgtgcgctattttcaggccagttactggcgaaacagcaagaccacgcattcgtatggtttgcgacgggagggcaccagcttagacacgaagccgacagcgatgaattacgggcggcagcggaagaatccgcggaaggcttgcgcgagcaccacaactggcagaaatcgcgcaaaccagagagctattttcgttaattaaacgcccctgcgcttcagcagcgttttcatcagcgcttcagggctcactgaagcgacaacgctgccgggctggggcatttttaagatgtggtttttaattttgccaatgacatgcatttcgcaagggcggcagtcgaattttagcgtcagtacctcatcaccatgcaccaactgcatcggcgtggctttccagctcttaatatttcctttcgcctgctttggacaaaggttgaacgcaaaacgcaggcagtgtttggtgatcatgaccggtacctcgcccttctcctgatgcgcctcataggccgcatcaatcaattgtacgccgtaacggtgataaaattcccgcgctttgtggttgtagacattagcgagaaagctgagatgcgtttgcggatagacgggcgcaggctgcgccacgggtttccgacgacctcgttgataatgggccagccgcgccgcgtcaagcatatcaatcgcctcccgacggaactgattgagcaggctatttggcacgaacaacgccgccggtaatgtcacctgcatatcacgcgcgtagtaaagcgtttgtcccagcttcgccagtccggctgttaggttattcaacgctttttcagagttgttggcttcctcaaataccccgtcaagcgtatgcgtgatgcagacaccgtcttcactggtcagtgtcagaataagctgttcctgccagccgcccagcatgatatcaaccgccacacggcgctcactggaggtttttgtcagcgcttgctgccagttatggtccagattacgattcaacggatgatgcggacggactttatgcaggtcggcaggcatatcatttggccaaacgcggtagcggttatgaccggttttctccaccgtattggcgcgaaaacccaccacttcacgcttaatcaacacgttcagaccatcgccattcgccaacggctccgtcgcttctacgtcgagataatccttcgccacattcagcacctcgcctaccggcaagccaataaattttggtgaatcaaatgcgccaatatcgcctttacgcgcgttaacaaaatagtcggtgctgccgcgatggaaggttttctccgtggagggaacaaaaaagtgctcggtccgaccaaccgatgcacgcgccagatcgccacgttgctcgataatcgcgtccagcatctgacgataatgcgcggtgatgtttttgacatagctcatgtctttgtagcgcccttcaatcttgaaggaacgtacgcctgcatcgatcaacgcgccaaggttagccgtttgatcgttatctttcatcgatagcaaatgtttttcgtaagagaccacccgcccctgatcgtcttttaacgtatacggtaagcgacaggcctgcgaacagtcgccccgattggcgctgcgcccggtttgcgcatgagagatataacactgtccagaataagcgacacacagcgcgccatgaatgaagaactcaatcgtggcgtcagtagcctgatgaatagccgctatctgactcaaattaagctcgcgcgccagtacaatctgtgaaaaaccgacatcggcaagaaacttcgctttttccacgctgcgaatatcacactgtgtactggcgtgaagctcaatcggcgggatatccagttccagaatgcccatatcctgcacaatcagcgcatccaccccggtattgtacaaatcggtgattaaccgctgcgcgggctccagctcatcatcatgcaggatagtattcagcgtgacaaaaatcctggcgccgtaacggtgagcaaacgggaccagatcggcgatatcgcgcagactgttactggcgttatgacgtgcgccaaaaccgggtccgccgatgtagacggcatctgcgccatgcaaaatcgcttcgcgagcaattgcggcgtcacgggccgggcttaacaattcgagatagtgaggttgctggcgcatacagtctttcttatccaatagcagcgaaatggcggctattgtagtcagaagcgcaaactaacgaaatagttttcccgcttaatcacgtgggtaatggatcagcgagtgaaaatgaaccgtctggtcactactgttgcgataggtatgcgccgtatcgccggcaaaacgcaaacctttaccggcgtctatggtttgccataccccaccagtacacatgtccagccgaccctgaatcaccaccacatgttcgataacgccggctttatgcggcgttgattcgctgaccgcgccaggcgccagcaatagggaaaaatagtcaaaacagagttcagggtcccacggaaacagcggtgtgattaccatcgcttgctgctggggatcgaaggttggaggaaattcggcctgcggcggcgaaataaacattgagaatggaacgttcaggcccgtcgcaattttccacagcgttgcgactgtcggactggattcattacgctctatctgccccaacatggcttttgagacgccggagatctccgccagacgtgataaactccagcctcgctgatggcgtaacgttcttaacgtggtcgccagatagtgtgtcaggttatccatttttcccccctgtaaggccatagcgtatcacttgtacgctataacgcacaatgctacattgactgaccgttataacgcacaagaggcgatcatgcgtctgttatcactgccgttacctactgtattatctggtctggtcgccgttctggtcggctatgcaagttccgccgccattatctggcaggcggcgcttgccgctggcgcaacacccgcagagatcgccggctggatgaccgccctcggtatagccatgggcataagcacactaacgttaaccttgtggtatcgtgcgccggttttaaccgcctggtcaacgcctggcgccgctctgttggtgacagggcttcagggattatcgttgccagacgccgtgggcatattcattgtcgccaatgccctgattgtgctgtgcggcgtcacgggattgtttgcgcgtttgatgcggataatcccccattctcttgccgccgcaatgctggcgggaatactgctacgcttcggcctgcaggcgttcgggacgctcaacggagagtttgtcatgtgcggcggtatgctattggcgtggctactctttaaagtattcgcgccccgctatgccgttattgctgccatggtgatgggaataacggtggcgctcatccagggtaagatggcgatgagcggtattcatttcgcgccggtgtggcccaccttcgttcccccccacttttcattcgctcaaagcctgagcgtcgcggtaccgctcttcctggtgacgatggcatcgcaaaacgcccccggcgtcgccacaatgaaggcgtctggctatcagcttcctgtctctccgttaatgatttttaccggattactggcgctgctgctttcgccgtttggcgtttattctatctgcattgccgccattacagccgccatttgtcaaagcccggacgcgcaccccgatccaacgcgtcgctggttagcggccgccgccgcaggcgttttttatttacttgccgggtggtttggcggttcgataaccgagctgatggtcgccctaccggttagctgggtgcaaatgctggctggtctggcactgttaagtacgattagcggtagtctgtatcaggcgcttactcacgaaagtgagcgtgacgcggcagttatcgcatttctcgtcaccgccagcgggctaacgctgatgggcatcggatcggcattctgggggttgatcgctggcgggataggctacgcaatattaacgagaacgcgccgcccgtcgttgtctggctgatggcggccgctaatctgccggggtttgcgccatcttgcgatggcgccgcagaattattttttgttagtgtcaaacatagaggtatccgtcgccatatcatccacaacctgtttcaacgtctcaaacgccattggcgtactggaattactcaggtctttaccttcgccctggcgcactaccttgacgaccggcttgttggtcgcggcatctatcagctcaccctcaaaatagaggtgggtatccatggtccggtggcccgtcgccatttgcgtgcccgccacaatcagcgctacagggatcacctcatagaattgcagcccttctttgctggtatccacgcccgtaatcgcctcgcggaaaatcaaactgcgcggccctgccgtcgtgaccagcggtttgcgctgttcaattgctgattttactttagtgttcgtataagccagcagtttatcaagaacttgctgtccgacctgggtcgttggcttggggatggggtaatatgttatcggattgtaaacaatactgtcatagttagagtcattaaaatgtggatctacccagcgcaacaccggtttccccgtggcggaagtagtctccttcaggtccgaataattttttaagaatccagaatacttatccggctgtgtgactttagacgcacagccggataacgccagcaagccagtaagcactgcaactttaaataaagtatgagtacgcatgaaacgatccctttagtcttcgcaatgatgcaaaggaaataatagcaaaacgaaatcattctggatgcactaaaaatggtaacgacagcacaatttgaacgcggcgcccgacaaaaaaatgccgaacgcagcaagacttacagaacttgcatcgctcaggccgtttttctcgccagcatcgtagcaaagcgcagtttgatacggttgccgttttcgtccgtgcggtgaagctcgccgacatcttcgttgtatttcagcatgtcccatccttcgtaatagcggcgtaattcgccttctttaaaagcgaacgggaatcccaccgtacagggaaagcccggcgtatccattgccgcaacaatcaaattatacccgccgggttttgtgcagcgttgcatattggcaattaaaccgggaatggtttgcgcctcaagaaacatcataaccactgtcgagagaataaaatcgtattcgccgtcaaaggtcaatgtattcagatcgacaaggtcggtttgcagattatccagcccttctgccgctttaatacgctcaaggttagccatactggccggatttttatcccacgcggtaacgtcataaccgttcgcggccagatacagactattacggccattgccacatcccaaatccagcgttcggcctggcgcgacaacctttgccgccgccagcacatccgaatgcgtgcgggttaaaccgtatttctcagtaaagtaattttcgtcacgaacggtcatttttttcctccgttttcaacagtgcagcgcgctcagtgcgaataagcaacgtcccctgcaccagcaatagaaatgtacgaaccagcaataaggcgataatagcgttagtgaaaataaacagcgggacggccagaatatggaaaaaccctgattcactaccgtgaccaagatgtaaccccgtggtcgtcagcgcggaaacgccgaacgaaaaactccagaaggaagcattaaacggttgtgataaataccagggcattaatcgcagcataaataaaagctgtaacagaccgtagccgaatagcattttcgccagcgtgtcgccctccccgccattgacgctcagccaggcgctacaggcgaccagcgcgggcgccagttggatacccagcgacatacgcagcaccgccggtaattcgccgcagctacgcagtcgctgcaaaataaccggttccagacttaaccacgaaaagacgcctgcgcctaaaaacaccagtccggcatcattgtaaccgagcgctccacaggccatagcgctgataaaattattcgctaccgtgggcagataaagtcctggggttgtcgcttcttccggatgcgctccgcgccaaagacccgccgtctgccaggcggcatacgccagttgtatgacgacccccacgctgaatagcgcaacggccaacgggcgataccagggaacgaaaccgatcgcgaccagcatcgtggtggcgggaaacaggctgacaaaactgctcattaccggatgtcgcacttcagccatcacgctatggggaaagcgcaccagacggctaaggaacgccagggtcaagagtgcccaaataatcatcgccaggatcaccatgatgtcgccgggccagtggcttattgcccatatctggctggcataacgccaggcgaatcccataccgatagtgccaaggacgatgccaaaatagcccgcaggcagattgagcacgcgatcgctctgcttgtgattacacattttgtttaatttataaagtatatttgaaatgcattttatggaatttctggttgtttcgccagtacctttgctacggttatcttaatcgttcacacggaatttccctatgatcaaatatcgactgagtgaagaacctcgtgcttttacttatcaggtagacggtgagaagaaaagcgtcttattacgacaagttattgccgtaacggattttaacgatgttaaagccggaacctccggcggctgggttgatgccgataatgtgctgtcacaacagggggattgctggatttatgatgaaaacgcgatggcctttgcgggcacggaaattacgggtaacgcgcgtatcacgcagccgtgcacgctctacaataacgtgcgaataggcgataacgtctggattgatcgcgctgatatcagcgatggcgcacggataagtgacaacgtcaccattcagtcctcttccgtgcgtggagagtgtgcgatttatggcgatgcccgcgtgttaaaccagtcagaaattctcgctgttcagggactaacgcatgaacatgcgcagattttacaaatttacgatcgcgccaccgtgaaccattcgcggattgtccatcaggtacagctttatggcgacgccactatcactcacgcttttattgagcaccgggcggaggtctttgatttcgcgctcatcgaaggcaacaaagacaataatgtctggatctgtgactgcgccaaagtctatggccatgcgcgggttatcgccggcacagaggaagatgctatccctacccttcgctacagctcgcaggtagcggaacatgcgttaatcgaaggcaactgtgtgttaaaacatcatgtgctggtaggcggacatgctgaggtacgcggaggtccgattttactggacgaccgcgtgctgattgaaggccatgcctgtatacagggcgaaattctgattgagcgccaggtcgagattagcggacgggcggcggtgatagcgtttgacggcaatgctattcacctacgcggcccaaaagtgatcaatggagaagatcgtattacgcgtacccccttagtcggttctctttaatccgcatcaataatgcgggcatacatattaacgtcgtgatagtcgccgttaagatactccgcctgtttcatacagccttccagcgtaaaatggttgcgccgtgcgaccgcgttactggcctgattatcaacgcggcatttaatgacgaagcgccgaatatcgccgcgccgggcataatgtgtcatcagcgcctgtaatgattgcgacattatcccttgcccctgaagggactcatccagccagtaaccgatataggcggctttgtttatcggctcgatggcattaaatgagagtacgcccgccatctcatcctggcagaaaatcaggtacattttggcgtaaccacgctggtgcaacagcatattaccctgcacatgcttacgcgtttcctcctgcgacgtgacatattgcggccagtcgagcgactgttgtagccacgctttgtttttgagtaccagttggtgcagcgccggaacatgactttcatctgccgctcgcagttccagcgtcgtgctaacaggaataatttccaccatcgcgttgcccttcttcgttgttggtcgtgatcacataaatagcctggtttaccgataacccgcaggtgatatgagcgtttttattgtatcgccatcacattattttttattgaccatatttagcgtatttccgcgtgacacatttcacacttatccaaccattctccgcctataaaacgctcaacgactgattgttttatcaccacggagacgccaatgaccttttctgtgcaggaaacgcttttttctttactgcggctaaacgggatttcaggacatgaaagcagtattgcaaacgttatgcagcacgcgttcgaacagcaggccaaagacgtctggcgggatcgcttaggtaatgtcgtcgcccgttatggcagcgataaatccgacgcgcttcgcctgatgatttttgcgcatatggatgaagtgggttttatggtacgcaagatcgaaccctccggttttttacgttttgaacgcgtgggcggcccggcgcaaattactatgcccggttcgattgtgacgcttgccggatgttcaggcgatatcatgggctgtatcggtattaaagcatatcacttcgcgaagggtgacgagcgcacccagccacccgcgctcgataaactctggattgatatcggcgcaaaagataaagcggatgccgaacgaatgggtattcaggtggggacgccagtaaccctttacaacccgccgcactgtctgggcaacgacctggtgtgcagtaaggcgctggatgacaggctggggtgtacggcgctactgggcgtcgccgaggccctcgcctccacaccgcttgatatcgcggtattcctggtcgcgtcggtacaggaagagttcaatattcgcgggattgttcccgttttacgacgcgtgcgccccgacctggcgattggtattgatatcaccccctcctgcgacacgcctgacctgcaggattactcggatgtgcgggtcaaccacggcgtcggcatcacctgtctgaactatcacggacgcggtacgttggcgggactgattacgccgccgcgtttgctgcggatgctggagaccaccgcgcacgaaaataatattcccgtacagcgtgaagtcgcgccaggcgtcatcaccgaaacaggctacattcaggttgaactggacggtattccctgcgccagtctttctattccctgccgctatacccactcgccagccgaagtcgccagcctgcgcgacctggctgattgtatccgtttactgactgcgctggccaatatgtcgccagaacagtttcccattgaccctgaaacaggcgctacacaagaggcacgaccatgatgaaaaagatccttgtggcatgtggtaccggcatgtcgacatcaaccatgattgcacaaaaactgcaggactttcttgcggagcaaggcattgcggcaaccacggcgcaatgttgtctgaatgagatcccgttgaactgtaacggtatggatctcatcgtaacgtccatgcgtacgcacagtgactatggcatcccgacgctcaacggcgccgccctgctgacaggcatcaacgacgacgcattaaaacaagaaatcaaggcgctgttaacacaataaagggggcattatgtttgattacatcctgtctctcggcggcaccgtctttgtgcccatcattatgattatcatcggcttaatctttcgtattccctggctgcaggcggtgaaagcgggggtgacggtcggcatcggttttgtcggcatggggctggtgatcgtcatggcgatcgacagtctcagtccgccgattaaagtgatgattgagcgttttggcctgacgctgcatgtgtttgacgtcggcgccgggcccgcatccggcgtcggctatgcgacggccatcggcgcgatgatcattcccgttatctttctgctcaacgtcggtatgctggtgactcgtctgaccaaaaccatgaacgttgatatttataactactggcactacgccattaccggaacggtcgtccagttgatgaccggcagtctgatttatggcgtactgggcgcgatttgccatgccgccttgtcgttgaaaatggccgactggacgacgaaacgggtacagaacattgtgggtctggaagggatttctattccgcaagggtatggctccagctccgtgccgttgttcgtattgctggatgcgatatacgaaaaaataccgtttatgaaaggacgcaatattgacgctcaggagatccaaaaacggtatgggatggtcggcgacccggtgatcattggcgttgttctcgggctgatcttcggacttgctgcaggcgaaggctttaaagggtgcgcaaccttaatgattaccgtggcggcgattatggtgctgtttccgcgcatgattcgccttatcgttgagggattaatgcccatttccgacggcgcgcgtaagttcttccagaaacactttaaagggcgcgaagtctttatcggtctggataccgcagtgacgttaggccacccgaccaccatcgcggttggactgctgttaattcccatcatgttaattctggcgagcatactgccgggcaataaagtcctgccgctggctgatttaccggtcgcgccattttttatctgcatggccacagttattcatcgcggcgatctgattcgtactctgctcagcggcatcattgtcatgattaccgttttgctgatcgccacccagttcgcgccgtactttaccgatatggcgctcaaaggcggctttagcttcgccgctgaaaacgcgcaaattaccgcgctgtcggtgggaaatatgtttggctggtcaatatctgaattgatgtcgctgggcatgattggtgtggttattgtggtcggcattgtcgccagcatcatacttgtcttacgtaaacgtgaactaccggaataaggagcaacccagaatgagttggctaaaagaggtaataggaacagaaaaagccgttatcgccatgtgccatttacgggcgctgccgggcgatcccgggttcgataccaggaaaggcatgaactgggtaattgaccgcgcccatgacgatttaatggcgctacaaaatggcggcgtggatgcggtgatgttctccaacgaatttagtctgccttatttaacgaaagtcagaccggaaacgactgccgcgatggcacgaatcatcggtcagttaatgagtgaaattcgcgtaccgtttggggtaaacgtgttgtgggaccctgtggcctcttttgatttggcgatggcgaccgacgcaaaatttattcgcgaaattttcaccggtgcttacgccagcgattttggcgtctgggatacgaatgtcggcgaaactattcgccatcagcatcgcatcggcgcaggccacgtgaaaacgctgtttaacatcgtgccggaagcggcggtgtatctgggaaaccgagatgtctgttcaattgcgaaatcgaccgtatttaacaataaccccgatgccctgtgcgtctcggggctgacggcgggcgcccgcacggatagcgccatactgaagcgggtaaaagataccgttcccgacacggtcgtgctggcgaataccggggtgtgtctggaaaacgtcgaggagcagctctgcattgccgacggatgcgtaacggcaaccacgtttaaaaaagacggcgtcttcgccaactttgtcgaccaggcgcgcgtggcgaagtttatggagaaagtacgccatatccgacaataaaatggggataagcaaaacgcttatcccctgcagagagcgataactcttctgccgatctccgtcgccttcgccaaaagacacgccggggatcggtttcagagtaacccgaaccggcaaggagtcaacgatcgatgattaatgatgttaagtgggttcaggcgcaacgccatgccagcgactggcgacacgcgctggatatcgccgttcgtccgctgattaccttcggcgcggcggccccctgctacctggacggtattattgagaacacccttaaatgggggccatattatcttatcgcgccggggattgcgctgccccatgccagaccagagcaaggcgccaaccataatcaaatcagcgtcactacgctatcaacgccggtcgctttcggcaatgcggattgcgatcccatctggctgttgctttgcgccagcgccacggatgccgaagcacatattcgcaccattcaacgcatcagccagtggctcgactcgccggaaagcgtcgcgatgttgcaagatgcgccaaatgatgccgcgcttttcgcgcaattaaccgcattgcgctgatgaaggttccgatgatcctgcacccttcactggcctccgccgatccgctgcgctatgccgaggcgttgaccgctttacacgatgcgcctctcggctcgctgcatctggatatcgaagataccagtttcatcaacaatattaccttcggtatgaaaaccattcaggcggtcgcgcaatactctcgccatccgctctcatttcacctgatggtttcatcaccgcaacgctggttaccctggcttgcagctatccgccccggctggattttcattcatgccgaaagcgtgcaaaacccctcggagattctggcggatattcgcgctatcggggcgaaagcaggactggcgcttaacccggcaacaccgctattgccttatcgttatctggcattgcaactggatgcgctgatgatcatgaccagcgaacccgacgggcgcgggcaacaatttattgccgcgatgtgtgaaaaagtgagccagagcagagagcatttccctgctgcggaatgctgggcggacggcggtattacacttcgcgccgcacggctgcttgccgccgcaggcgcccagcatctggtgattggccgggcgttgttcacgacggcgaactatgatgtgacattgtcacaattcaccgcgctataaaggagtcatatgctgatgagccaacagcgccccgaccgtatcaaacagatgttgcattacctttggcaacacaggcacctctcaacacaacaagctattgagctttttggctatgcagaggcaaccgtgcgccgggattttcactatatcgccagccgttatcccggtatggttcgcggccatggttgtattgactttgacgacagtacggaagataaagaatatgttttcgacgttaagcggacgttacaaagcgaggcgaaacgcgaaattgccgccctcgcccgcacgttcatcaaggatggagactgcttttttctcgactctggctccacctgtctggaactggcaaaatgtctggtcgacgccaaagtaaaagtcatttgcaatgacatcaaaatcgctaacgaactgggtggcttcccacacgtagagagctacattattggcggactgattcgccccggctacttttcggtgggcgagagtctggcgctggagatgattaacgcctttgccgttgaacgcgcctttatctcttgcgatgcgctgtcgattgaaacgggcatcaccaacgctaccatgtttgaagtaggcgtcaaaacgcgcattattcagcgctcacgcgaggtcatattgatggccgatcattcaaagtttgatactgtagaaccccatgcggtggcgacgctgtcctgtattactaccattcttagcgacagtgcgctcccgtctgctatcgcccgacgttatcagcaggcgggatgccgtctcatcatgtcagacccctcatcaggagcgcgttaatggacatcaggcaaatgaacaaaacccatctggagcactggcgcggattgcgaaaacagctctggcctggtcacccggatgacgcccatctggcggacggcgaagaaattctgcaagccgaacatctggcatcatttattgcgatggcagacggggtggcgattggctttgcggatgcctcaatccgccacgattatgtcaatggctgtgacagttcgcccgtggttttccttgaaggtatttttgttctcccctcgttccgtcaacgcggcttagcgaaacaattgatagcagcagtgcaacgatggggaacgaataaagggtgtcgggaaatggcttccgatacctcgccggaaaatacaatttcacagaaagttcacctggcgttaggatttgaggaaacagagcgcgtcattttctaccgaaagcgttgtcgaggaaaatcacacaggaaaaggtcgggtataatacccgacctctatattactgtattactgtggcagatctttttcagttaacaagcgtgtcgttttcacttgttcaatattcctggcgccacccaacatcatgttaattgtcagctctttgtttagctgttcaatcactgatgccacaccctgagcgccgccaagattaagaccgtataatacaggtcggccaaccgccacaatatccgccccgctggctaacgccttgaatacgtgcgaaccacggcgtactccactgtcaaaaataacaggcactcgcttgttgacgacttttgcaatcgcaggaagcatatcgaatgaggacggcccgctgtctaattgacggccaccatgattagaaacccatattcctgcggccccagcctggatagcaatttcagcatcctccggcgactgaatgccttttacaataaccggcagaccggaaatacgatgtacataggcaatatcctccggcgtaaaggcttgtttagcctgcgcgtaaatttcacttatccctgcccctttgccggtttttgaaccatcgtcatttttcctggcgaacatttccaggtttgcaaaactcagcgggaactggaagttatttttaatatcttcttcccgataaccgccgacaggtgaatctacggtcagaataatcgctttagcgccatgttttaccgcttgtgcaagaataaattcgttaaattgattattcttactcatataaagctggaagaagaacgggtttttcccggaaacgttagccacctcttcgatggtcttgttgccataagtgctcaacgagaaaatcgaaccgacctgcgccatgcctttcgccgtcgccaactctccggaggcgtgggccaggccctgcgccgccatcggtgcctggattataggcgttttaagcggaatacccagtagctgcgttgataaatcgatctcttttaactcaatgccctgtaatacgcgcggcataatatattttttgtcaaagctttcggtgttgctgcgaaggttattctcatcttcggctccaccgcgaatataaccaaatgcccctttctccattctggcctgaacgcgcgcttccagagaggctacgttcgtcatttttattgctttttcgtccgtgctggctttgtactcttcagcataagccaggcctgatgttgccaacattgccagcgaggccactacccgaatgaggtgatgagttttcatcattattccttttattgcttaaccgcttctgcctggatttttatatcgacaactttcgtcatccccatatcgaccagataatctacaccccactgggtgcgatctatttgcgtgacaaaatcaccaccgcaaacctgcgccttgaatatcgggctcatataacagccaaacttggtggtggttaaggtgacgggcttagttactcccttcattgttaacaaaccgtcaatagaaactggtttattatcttcaaaatgccattttgtcgatttaaatactatttctggatatttttccgcatccaaaatatcgctactgcgaatatggttatcaaacgcatccaccccggtatttaaggcgctcacgggaatcgtcacacgcatctctgcgacttgcttttccggctgatatttcagttcgccgctaatagcataaaacccgccatgattggttgaggtctggaaacgatcgatattaaataccgcattggtatgcgtattatcaaatttatatacatctgcatgagcagcacttaataaacccagagacaggagagcaccaagaaaactctttttcattatattcactttatatcttaaataaggtgaagctatcttaatgtcccctgtccgcaggatcgagagggataaacaggaaggactgttgcaaaaatagaacgatgaaaaggccgtgtcacaaaaacagcggctcacgaatgggtttatgtcatggcaatttccgcaacctgtaccgcctttgtggcggtacagaaggcaaactgactaacgcatgatacgatcgtcgacataacggcgcttatccggcgcgggcgggaaatactgatacagccaggtttcgctgatagcctccccctggcagcgcaggaacatacgcatatccaccggtgccgtagaatccgaggtcggataccagtcaaactggatacgataaccgtcgaaaggctctacgtagaggatctcaacctgcttcgcctcaccgctggagagcgtaattaccggctcaatgccttttggcgcggccgctttcagatcgccgccgacaaaatcaatagcaaaacggcgtgcccatttatccgggtaatgttcgcccggcgcccagccttcgggaaagccgcccatccctgtacgggtcgccatgacccgcgcaagcggcgattgtaccggcggctgcgcgctccagtacaaacgataattaaacgccagcgtatccccggctttgatcgctttttccggctgccagaaacagaccacattatccagagtttcgccagtggttgggatctccatcaggctaaccgcgcctttcccccacttactgcgcggctccacccacaggctcggacgtttgttgtaccagcccatgacatcctgataatgcgagaaatcgcgatcgagttgcagcaggccgaacccttttgggttatcgtccatatatgcgttgaactgtaatttctgaggattattcagcgggcggcaaatccactcgccgttaccccgccacatcgccagccgatcggaatcgtgaatttgcggatgaatggtgtcgcatacccggcgttcattattcccacagctaaacatactggtcatcggcgcaatgccaagttgctttatatctttacgggcgtagagatggttttctacatccatgatcacctgcgttttttcgcaatggatcacaaacttatacgcgcccgtcacgctggcgctgtccagcagagcgtaaacggtaaacgtagtatcgcccggcttcgcggtgtcaaaccagaatgcggtgaagtcagggaactcttcctgaccgtcagtataggtatctatcgccagcccgcgagccgacaggccatactgataagtatcatctaccgcccggaaataactggcgcccaggaaggagacgacatcgcgccgcgccagttccggcgctttaaagacacggaaaccggcgaaaccgagatcgctctgcccttccagttgcgtcgtatcaacgccggcatcgttgtatttaaacagttccgggcgaaaatgaatctcgcgagcaagatgcgtcgtcgtatcaacggaaaacatgcgtacgcgacgacggaagcccatccctacgtggaaaaactgaatatcgagctgccggttggcaacaccgttccagagtgaatgcgccgcgtcatactgaatgctgttataggcctgcggcgtcagattggcgagcgtatccggcaagggtcccggcgcgccaccccagggctttttcgctaacgcctgggccattgattgcagaccagcaaaatcaaaacggacaattttaccatccgcaatatcggattccgcggcaaacgccgcctgagaaaagagtgaagcaataccgctggaaccgcacacggcggccattgccattgaacctttaataaatcgtctacgattcatacctgaaaatgagtccttctggtcttgtgaatggtcccgcgctggttttttcagcagcaagaatgtgcccgtttctgaccgctcactctagacaaaattcattaataatccaattgttggtcgcctggaaactgtgcaaaagcgtaaatattttatgtcgataagaaccgaccgaatcggatgtaaacctcacgcagcattcttcaggttatgaaaagtttattccagactaacgtgatgtttcatgactcgtttaaacagcgccagacgcgcacgcataaagcggttttccactttaaaaccggcaagtttgttcagcccaatccgcaacagacgatctcgcccccgaatgctggcgggccagcgaaccgggccgtgcagcacgtcgcgcgtgcggctggcatgacgagcgaaattcacccagtaatccgccacctgcgaggcaaaggccaggtcattctcattcacataatggcatgtgggctcagcccgcgttaacgtatcgaatacatacggtatttcattgccatgacaggcgctattcgcgtaggtgttatgctccgcctcggcgacataatcaaaccagtaacgccagcacggttcgccgatccgcttctgcgcttgcatgacgacataacccaacgtggtaaataccatatcccgacagacctgccgccctagcgcttcgtcgcctttcactccaggataaagcagccggattaaccccaagccaacacgccgctcacggcgcattttttgaatttgaccggcaatatcgacgccaaaaacggccaatacgctggcttcatcgctattcgagccgatcatcaccggtattggatgctgtttcgccgcaaagaaggtttccagcatcggatgcggcagcacgacgtcgccggaaatcggcgtcggcgcaattttaaaaggcgcgtccagcggccaaaacgtctctgccggtaaagcgcgtagctgttcggcagtggcatgggctaaaccaagatgttccgccagcgcaacgcctttttttagcgccacctcgcggggcgtatccggcagcgtataaccactctgaataatcgctttatgaaaaagccccttcgccaacggcgaagccatcaacgacagcacgctgcgggcgccggcggattcgccaaataacgtcacattctgcgtatcgccgccaaatgcggcaatattgtcctgcacccaacgcagcgcagcgatttgatcgagtaaagcgaaattatgaatacactccgccccttcgccttccagcgccggatgcgcgaaaaagcccagatggccaagccgataattgaccgtcaccacgatcgcgccgcgcttcgccagcgcttgaccgtcatagggcggcaaactccccgcgccaatggtgtaaccgccgccgtgtagccagaccatgaccggcaacggttcatgacgcacggcgggagcccagacgttcagatagagacagtcttcggaaaaatttcccggatcgccgccgccgagttcgcgacaccaggtaatatcctgccaactggcgcaggagaaacaatccgcctggcgcacatcctgccagggcgtaacaggctgcggcgcacgccagcgtagctcccctgttggcggcgcggcataaggtataccgcgccagatatggatttcttcctgtacgacgcccacgattttaccgtgacgcgtcgccaccagcgggatggagggattcaacataacgccttccttttacagtatcctcacagcctgtgaagcttaccgcttttaaagcagaccgcaacggcgtttactgcgttcttccgcttcctgatataacgaaaattcatcccgtacagcacatcccagcgcctgttcaaaggcgtcgcggctggcattgccgtggcttctggccagcgtttcatttcccaaattcgactgaaaaatgccggctgcgctgaccggaagaaaatcttcataggtaatcggctgcgcgatcacccaaccgcgctcaataagcggctgcggatcgtcgccaggatggatcgcctgacgatgcgcctcgccggaaggcgttaagcgataacggaaccaggcaagcccctgcaggcgaagcagaaattcgctatccggaaaggcgttaaagacctcccgcaaatggagttgatgcgtgaagttgtccttacccgttcccgccttgtgcaacagttcgtcatataatcgacgaccttttggcgtcagcgcgacgccacgttgctcaatttcgccgaagcgcgccgtgtgcgtaccctgcttttcatcaacgaagagcacctgctcttccagagctttgaaactggtttgccgcaacagaataggcacttcgcggcgaggcggaccttcgataagaattttaggcgtaatgccgcactccggcatcatggcctgtacccggtcgatatccagagtacgcggcgtcagatggttaatgtggcatcccggaaaacagaccacgtcggcaattaaacgatgctcacgatgcaggctgcggtacgtttcttcatcaacggtagcctgacgatgccagcgaaaagtctccagcgtttcacggacgaactcttcggcctgagcagcactaaaaccgccctgctcgtcgtactcatccagcaattgtcggcagcgcgatgtaaaaatatcacgctgcgataagatttccgccgcccgctggcgtaatgccgcgttttcaatgagctccaggcgtaatagcgaagtgaacatgcgaaagggattacgcgagagcgaagcctcgtcaatgggacgaaatgccgtggagtgcacaggcacgcccgcctgagagagatcgtaataacttactgggtacatccccatgatggcgaatatccgacgcaagttcccggggctaaagaccctcagctagatatatgtccgcaatacgtcttcaatgactttgtccatccaacccaggaagtccatcattgttttgccacaatgttagaaagttttatagctcatcattattccactgaataatgttccatcggctgcggtacgccttgagcaaaacaccgctcaatatcatagtgccggtgacatgaaaatatgaggttgtctttgctgccggttggtcaataagtgatccatactctatgttcagtaggacaaaaatggatagagtcgatagatcgccaccgtaactacaatactcactatcacactggcgataaagtatgttttgaatggctgcttttgcgttttatgacggaaaagttgttgaccaacaatcgcaccaggccacccaccgacaaccccaaacaccaacaaagtggattccggcactctgcgccaggttttacgtgccgccgttttatctacaccgtagatcgccagcgttagcacattggcgagcaggaaccacatcgcgacgggatacgatgtaaaaatgcttccgaccgcagcagagatcaggagtaaataacaaaagcggttaagatacatattattatgtcatagcaatgattagggacatcggagcccattatacgcgatacatgcgcctatgtgatgcagaattttcttttcattcagccaacgagtcatcgagtcatcgaggattcatttttaattaccatggtaatcataaggtaattaacgtgttgtgaacacgattaaaatgggtaaagccaccaaaaatgttaccaccttaaccattgccaggataacttaatggagagccctctttattgctgtttgttatccggttggcagtctcagttttggatttatttatcgtatttatgtttattacataagatgtacgatgttaatttgagaattttatcccgacaaccgcatatattaagatatttctgaattaagattattatcgattaaaacaagttaacgttttgataaacataacaacatcgtcagaactcctgatttgttgtcgtttgttcataggataaataatttatatgcttgcaaatatagatagcacgcaaatcaatttagctcagaaaatgtatttgacaagcaaagataagtctttatattggccctggatagagtggtaagatgatacttagagacattaaatacaccgtcactgaagcatttatctgcttatcatgtaaatatgtatgcgtaaatggagcataaactatgtccagtatactaatgtctatggtatctttacattttcacctttcattgggtcgctgcactcatatccagttgatatctcatggtatattcaatccattccctttgatgattcctgtcaaacctcctgattaaattagttaacagcgatggaatacataacgttaagtactttacgcctgcaaatgtcaggttcacgctctaatgcttaatttataatacgtattaccttaccacaggaaatagatagcatgttatccaaaaaaattggcttatcgatgatagtgttgggaataatgtcgtcttcagcttttgctgatagcatcgttgaagggagaacactcaatgtcgcagtatcaccggcctctccccctatgttatttaaaagtgctgatggcaaattgcaggggatagatctggagcttttttcgtcttactgtcagtcacggcattgtaagctaaacatcaccgaatatgcctgggatggaatgcttggcgcagtggcgagtggtcaggctgatgtagcattttcgggaatttcaatcacagataaacgtaagaaagttattgatttttctgaaccttattacatcaactctttttatctggtcagtatggccaatcataaaataacgctcaataacctcaatgaattaaatcaatattctattggataccctcgaggaatggcttactccgaccttatcaaaaacgatctggagcccaaaggatactactcgttaagtaaagtaaaattatatccaacctataacgagacgatgactgatctaaaaaatggtaatcttgatctggcttttatagaagagccggtttactttaccttcaaaaataagaaaaaaatgccgatagaaagtcgttatgttttcaagaatgttgatcagcttggcattgcctttaagaaaggctctcccgtgcgcgatgattttaacttatggcttaaagagcaagggccacaaaaaatatctggcatcgttgataactggatgaaatagtaagctatgtcatcaggtaatatgctggctatcttttatttcctattggaagggattggtaatacgctgcttgtaacctttacctgttttctctcagcgtttttgaccgggcttacagtcgccgtattacggcgactatccccccttccactacagaagatactcgacgtactggtctttattcttcggggaattccaatacttattgctgtttttcttgtttattttggattgccatcgattggcatatatgtttcacctctggtggccatgaacctcagcgtcggcttaatcagcgggagttatcttgccgaggtgttcagaggggcgcttaaattagttgagccattcgaaataacggtagcgaaagtagcaggaatgcgtcaattacaggttataataaatattgaactgccacagatgttgcgattttctgtgcccggtattatcaatgagttttcttctgtattaaaagcgacgccctttgcttatactgtaggcatcgctgaaataacgaagcaggcaatgtcactgacagccatcacgctgaacgggttacagatctatacccttgccggggtattatatttcattatttataaagcatttactcttctggccggagtgtttgagaaaaaatatcgcatcagttgaaacataaaaatagaggtgatactcatggctttactggaactaaaagagataagtaaggaatattcaggaaaaaaggttcttgatgcggttagtttgaaaattcaatcgggagacatgaaagtagtcatggggccatcgggttgtggaaaaacgacgcttttacgctgtctgcttcgattagaagaacctgattatggcgatatttattttcacggggaaaatatttacgacaaagaatttactattcttgagttcagaaaaaaagttggttgtgtcttccagaattacgcattgtatcgccatcttaacgtcatggataatattacccttgccctatgtaaagtgtttgggatgccgggacaactagcccgggagaaagccttacatgagctacaaaaacttgatatggtctcgcatagcgcgaaatacccttcgcaattatcgggtggccagcaacagcgcgtcgccctggcccgtacaatggtcaccgacccagaactcattatttttgatgagccgacgtctgcgcttgatccgctcatgactcgtgaagtcggaatgttgatcaagcaacttcacgacaatggcgtcactatattatgcgtcactcatgatattcgcctcgccagattactaagcgataacgtaacgtttcttaatcatggcaagattcgtgcagaaggcgcttttaccgatcttgccttacgagaaacggatccagatatccactgtttttttagcgaggcacaacgatgatcgctggctggtctcttttctttaatgacctgactgaacaactgccacttgttgtggacggtattaaagaaacctgtaaacttgcgctgattgtttccatcaccggttttttgtggggaattattattttctttctgagcctgagccatcgccccgtggtaaaagccataactcgactgtacatggatttctttatcggtacgccactcattcttattctgtttgttatctattatggtttacctcaatctggcattcacctgtcctcttttaccgtggcggttacaggttttaccttgaatgtcggcgcatataatgccgcgtacatgacaacggcctataacgcattgaataagtatgaaacggaggcagcagtcgttcaggggttgaacaaacggcaggtctttttgtggattatactgcctcaggtattgctgtcttccattccagccttaacgaatcaggtgattaataaccttaaagacagcaccatcgtttttcttatccaatatactgagtttttcgcgcgaattcaggaggttgctgcaaccagctttaaattcttccatgcttacctttttgccgccatagtgtaccttattggcgttacctttattgtcggtttgacccggtttttagagcatagactgcttcgccattacggtcaggattactgagttgtactgcactattctgattaattcaccgctgacattatcaaagttatttttatttagtgttggttaagattttaaccttcattattgcgttaggtgtccattctggtctaagtcttactccattgaggatattatggcgctaccacaactatccatatggcagcccggcgatgggttaagaaaaataaagtataaatatcatgtttgtctcattgttatattctccgtccttatacggttgctgtttttaactgaccgctacctttggtgtgacgaagcgtccagcgtgctgattagtcgacatagcgtagataatctgctcttccatgccgcttttgacgtgcatcccccgctttattatctgttactgcatgactggatcatattattgggtgatagcattgcagcggtacgctctctcagtctactctttgggatcctgacagttgtgctggttatcgcgcttacgcgatggctggcaaatgaacgtacagccttattggcgggatggttcgccgccctgatgccgatggcagttcattacagtcaagaaacgcgcatgtacgcgttaatgggaatgctaacgctcgctgccgcgttagcattgatgatgtggataaaaacacccacccataatcgctatcttgtcgcgtatgctttacttatgacgttcagcttttacacccattatttcaccctatttacacttattgcccactggatcgcagtaacaatattatcctgccaaagccataaaacggcctgctaccttaaacttcctggctggtggtttgctaacctggcgattgctgtcgcttatctcccctggttgcccgtattgtttaatttactgactcatctggcgcagttgagagccggtaatgatatcggttggattccccccgtaacatggcgtgacctgcctgcgatgtactggcatttttttaccggaaacaacggacagggttttccgtcgttcattctgtggctggctgtgggaggttttatcggtactgtggggcgaatatctttatacaacggagaatatgaaagatatcagctgatattattttgtaatctggtcatccctgtaatgctggtcttcatcatttcctggtggatgccgttatttatcgatcgttatttcttcttctcatcgctgagcattcctcccctgctcgcggtattacttacccgcgcaaaaaaagcggtttgtggcttctggtttatcttattcaccttattattcggctatggttcatatcataataaccctgagcacatagacgagtttaaaccactggtaaactatattaatacccgtcaccagcctaatgatgccgtggtagtcagtaaaatgttcgattatttaagttatgtgtattataataagcgagattatcgtacgtttctttatacaccacctaacgcacacggaacatcaggaagaccgaatgcctatggctttggttcactgttttatgcgcaagccgatcagacatatattgatactctgacaacgctttcaaaaagttaccatcgtgtctggttggtaagcggcggtaacttcagtcaggattaccccttgccgtcagaatggcaaaatatcgcaaaattcagaagtggtagatttcaggtacaattatttgtaataccaactcaacaggcgcgtcaaatgcaatgattaccgttttctatccagtgcagtgataaacagtactgccactgccagaccgcctaaaagtaaggtccagccaaacgcttcaaaaacctcaatcatatcgcctccaggtaggtgatattaaataaagatggctatctcagcgtaacatttaaaatatcaattaatgtgcaataatcgctttatgtgtatgaataaatattgttcctcatgcatttaattgcattgctattatcataaggcttaatatatttatattaacgattattaattatcagcttataataatatgactgtccaattcatttatcagctattattatcctctatattctttaagatagccgtttaattaataatatcgcctttattcatcgcattaaattactcactcacctgattaatgcttgcctaacgattacttcgttgttttaattccagcgcgaaattatttaatgagagaacaatgaagcatacacaacaatcaggcgcaaaagtctataacccattcacgcttagcttatatgactggtgggtactcaatatctcaaacaaatatgcctggaagtgtcctactgatacgcgactacttcctttcttcctgcatcacatgggcgagactcacctggatattggcgtaggtacaggttattacctgaaacatgcacctgcgactcatgccatttcgctgatggatttaaatccggatagcctgaaaatagccgccagccgagtgggtaatacgaaaatccgcgccacactacaacacgatgttttcgacacgttcccggcggactggcacgggcgcttcgattccgtttcgatgtactatcttctgcactgcttacccggtgagatgacaacaaaagcgaaggcaattaaaaatgccggtatggcgctaaaacccggcggcacactttttggcgccacgattctgggcaaagaggttcctcacaatgcttttggtaagaaattaatggctgtttataacaagaaaggaatattcagtaataccaatgattcagccgatacgttacgcagcgtgttggacgaacatttcgctaaggtgactttggagcaacatggcgccgttgcgctattttccgccactatgccacgttcattgtaggtgtaggcacttccgggcggtcggcagcgcgatcatgtgggtttaacccgttgattaaacattggattacggaatagtaattgtttattttatttgtcatacaaataagtataatacccgcttccgatgtagacccgtcctccttcgcctgcgtcacgggtcctggttagacgcaggcgttttctgtatggaatacgccatcccctctgatagatgccttgtttgcctaaagcagttaaccccgcctgtagcaaacgtcatacaggacggtcagttacgcttacgcggcatcatccgtaacagcgtattgtctttccagaaatagtgatgcatcaaagcagcgatggcatgaagtccaataacaaaatagcccagattcgccagcgtgacgtgccaggatttcagcatatctacgcgttcaaagttagcttcggcggcatgcggcatagtaatgccaaatgcgaaccagggattgccgcggttatacatcatgaccagaccaataacaggcagcacgataaataacaggtaaatcaccagatgtcctaaatgcgccattccggtcatcatcggttttggacgaggaacaatgggcggcgtgggatatttcagccgaataatcaagcgcgccaccattaaaagcaaaatagtgataccacatgaaacatgcgtcatattaaactagggccgataactacgcggcgcaaaaccgcgtagctccatcgcggcgtaagccacaataaccagaaaaaagactaaccagtgaataccaatttgcaggccggaatacttattgcccatagcgcgtcctgaatgaaaaccgtaaagcgacaacataaccagcttttataaataattcatcaaatttatgaaatggtggtcgcacttgcccgttcaccctcgcaaacgggcgatttttagcgtaaagctctctgttctaacgcactgcgcagcgtcgtatctgcctgcaatacctgccatgccttttcaatatcgcgtgggatatcaacgtgaatgataaaatctttaccacgcggtccataccctgtttcatcgtcacgcaaacgtggcagctcgccggcaatcagagacagataacgctccaccgtccagatgccctcttcaacgttggcaaaacgtgtaccgccgttaaggtggcgcagtaccggaacaaaaccaggaaaactcagccagcgcggcgcatcggtgtcgtcgtttgtcacgcgccgaaacgccgcgatagtgcgccgctgcatggtggggtcttgcacaacgatagccgtgttaatgttttctttcgcctgacggatcagtgcgcaggagaaacgggcattttcgccgcaattagttgaccgatcttccagccaaattttctcagccggaatatgccagaactggttcgcgatatccgcgaggatagcggcttcagcgcgtccggttgtgcgaatagtatggtagcgcggatgccgggcaatcacggcgtacaaaaacggcgtcgaatgacctataccgccgctaatcagtaaaggaacgccttgcgctttggcgatgcgacaggccgcgtcgatagtggggatcaccgcattgcccgccaggacgacgcaatccgacgaataaggttgttc
